United States Patent
Maor

(10) Patent No.: US 9,562,235 B2
(45) Date of Patent: Feb. 7, 2017

(54) MICRORNA COMPOSITIONS AND METHODS FOR ENHANCING PLANT RESISTANCE TO ABIOTIC STRESS

(75) Inventor: Rudy Maor, Rechovot (IL)

(73) Assignee: A.B. Seeds Ltd., Lod (IL)

( * ) Notice: Subject to any disclaimer, the term of this patent is extended or adjusted under 35 U.S.C. 154(b) by 542 days.

(21) Appl. No.: 13/514,056

(22) PCT Filed: Dec. 6, 2010

(86) PCT No.: PCT/IB2010/055600
§ 371 (c)(1),
(2), (4) Date: Jun. 6, 2012

(87) PCT Pub. No.: WO2011/067745
PCT Pub. Date: Jun. 9, 2011

(65) Prior Publication Data
US 2012/0272408 A1 Oct. 25, 2012

Related U.S. Application Data

(60) Provisional application No. 61/267,052, filed on Dec. 6, 2009.

(51) Int. Cl.
C12N 15/82 (2006.01)
A01H 5/10 (2006.01)
C12N 15/113 (2010.01)

(52) U.S. Cl.
CPC ......... *C12N 15/8218* (2013.01); *C12N 15/113* (2013.01); *C12N 15/8261* (2013.01); *C12N 15/8271* (2013.01); *C12N 15/8273* (2013.01)

(58) Field of Classification Search
None
See application file for complete search history.

(56) References Cited

U.S. PATENT DOCUMENTS

| | | | |
|---|---|---|---|
| 3,791,932 A | 2/1974 | Schuurs et al. | |
| 3,839,153 A | 10/1974 | Schuurs et al. | |
| 3,850,578 A | 11/1974 | McConnell | |
| 3,850,752 A | 11/1974 | Schuurs et al. | |
| 3,853,987 A | 12/1974 | Dreyer | |
| 3,867,517 A | 2/1975 | Ling | |
| 3,879,262 A | 4/1975 | Schuurs et al. | |
| 3,901,654 A | 8/1975 | Gross | |
| 3,935,074 A | 1/1976 | Rubenstein et al. | |
| 3,984,533 A | 10/1976 | Uzgiris | |
| 3,996,345 A | 12/1976 | Ullman et al. | |
| 4,034,074 A | 7/1977 | Miles | |
| 4,098,876 A | 7/1978 | Piasio et al. | |
| 4,666,828 A | 5/1987 | Gusella | |
| 4,683,202 A | 7/1987 | Mullis | |
| 4,801,531 A | 1/1989 | Frossard | |
| 4,855,237 A | 8/1989 | Morinaga et al. | |
| 4,879,219 A | 11/1989 | Wands et al. | |
| 4,945,050 A | 7/1990 | Sanford et al. | |
| 5,011,771 A | 4/1991 | Bellet et al. | |
| 5,035,323 A | 7/1991 | Daniels et al. | |
| 5,187,267 A | 2/1993 | Comai et al. | |
| 5,192,659 A | 3/1993 | Simons | |
| 5,268,463 A | 12/1993 | Jefferson | |
| 5,281,521 A | 1/1994 | Trojanowski et al. | |
| 5,283,185 A | 2/1994 | Epand et al. | |
| 5,316,931 A | 5/1994 | Donson et al. | |
| 5,399,680 A | 3/1995 | Zhu et al. | |
| 5,464,765 A | 11/1995 | Coffee et al. | |
| 5,466,785 A | 11/1995 | de Framond | |
| 5,569,597 A | 10/1996 | Grimsley et al. | |
| 5,604,121 A | 2/1997 | Hilder et al. | |
| 5,608,142 A | 3/1997 | Barton et al. | |
| 5,608,144 A | 3/1997 | Baden et al. | |
| 5,608,149 A | 3/1997 | Barry et al. | |
| 5,659,026 A | 8/1997 | Baszczynski et al. | |
| 5,693,507 A | 12/1997 | Daniell et al. | |
| 5,759,829 A | 6/1998 | Shewmaker et al. | |
| 5,952,657 A | 9/1999 | Alexander et al. | |
| 5,987,071 A | 11/1999 | Iwamatsu et al. | |
| 6,553,252 B2 | 4/2003 | Balkin et al. | |

(Continued)

FOREIGN PATENT DOCUMENTS

JP 63-14693 A 1/1988
WO WO 87/06261 A1 10/1987

(Continued)

OTHER PUBLICATIONS

Sunkar et al., 2007, Trends in Plant Science 12: 301-309.*
Jones-Rhoades M.W., Bartel D.P., 2004, Molecular Cell 14: 787-799.*
Mendu V., 2008, PhD Thesis, University of Kentucky, pp. 1-174.*
Sunkar et al., 2005, Plant Cell 17: 1397-1411.*
Wu et al., 2007, Development 133: 4211-4218.*
miRNA Search Results, miRBase, pp. 1-16.*
Wang B., Xi Y., 2013, Microarrays 2: 34-50.*
Tarca A.L. et al., 2013, Bioinformatics, doi: 10.1093/bioinformatics/btt492.*
Mendu, 2008, PhD Thesis, University of Kentucky, pp. 1-138.*
Communication Relating to the Results of the Partial International Search Dated Mar. 24, 2011 From the International Searching Authority Re. Application No. PCT/IB2010/055600.
International Search Report and the Written Opinion Dated May 27, 2011 From the International Searching Authority Re. Application No. PCT/IB2010/055600.

(Continued)

*Primary Examiner* — David T Fox
*Assistant Examiner* — Bratislav Stankovic
(74) *Attorney, Agent, or Firm* — Amanda Carmany-Rampey; David R. Marsh; Arnold & Porter LLP

(57) ABSTRACT

A method of increasing tolerance of a plant to an abiotic stress or increasing biomass, vigor or yield of a plant is disclosed. The method comprising upregulating within the plant an exogenous polynucleotide of a microRNA or a precursor thereof, wherein the microRNA is selected from the group consisting of miR-156, miR-169, miR-164, miR-159, miR-167, miR-529, miR-168, ppt-miR395, sof-miR408a, ath-miR408, miR-1039, miR-1091, miR-1118, miR-1134 and miR-1129, thereby increasing the tolerance of the plant to the abiotic stress or increasing the biomass, vigor or yield of the plant.

6 Claims, 6 Drawing Sheets
(6 of 6 Drawing Sheet(s) Filed in Color)

(56) References Cited

U.S. PATENT DOCUMENTS

| | | | |
|---|---|---|---|
| 6,656,805 B2 | 12/2003 | Kamath et al. | |
| 8,030,473 B2* | 10/2011 | Carrington et al. | 536/24.5 |
| 2002/0058815 A1 | 5/2002 | Liu et al. | |
| 2003/0037355 A1 | 2/2003 | Barbas, III et al. | |
| 2003/0175965 A1 | 9/2003 | Lowe et al. | |
| 2003/0180955 A1 | 9/2003 | Ozasa et al. | |
| 2005/0144669 A1* | 6/2005 | Reinhart et al. | 800/285 |

FOREIGN PATENT DOCUMENTS

| | | |
|---|---|---|
| WO | WO 93/07278 A1 | 4/1993 |
| WO | WO 99/53050 A1 | 10/1999 |
| WO | WO 99/59029 A1 | 11/1999 |
| WO | WO 99/61631 A1 | 12/1999 |
| WO | WO 00/59035 A1 | 10/2000 |
| WO | WO 02/00905 A2 | 1/2002 |
| WO | WO 2005/100574 | 10/2005 |
| WO | WO 2008/010859 | 1/2008 |
| WO | WO 2008/098148 | 8/2008 |
| WO | WO 2008/133643 | 11/2008 |
| WO | WO 2009/086229 | 7/2009 |
| WO | WO 2009/135077 | 11/2009 |

OTHER PUBLICATIONS

Ding et al. "Differential Expression of MiRNAs in Response to Salt Stress in Maize Roots", Annals of Botany, XP002628342, 103(1): 29-38, Jan. 2009.
Kong et al. "Differential Expression of MicroRNAs in Maize Inbed and Hybrid Lines During Salt and Drought Stress", Americna Journal of Plant Sciences, XPXP002628341, 1: 69-76, Sep. 2010.
Li et al. "The *Arabidopsis* NFYA5 Transcription Factor Is Regulated Transcriptionally and Posttranscriptionally to Promote Drought Resistance", The Plant Cell, XP002637527, 20(8): 2238-2251, Aug. 2008.
Liu et al. "Microarray-Based Analysis of Stress-Regulated MicroRNAs in *Arabidopsis thaliana*", RNA, XP002577863, 14: 836-843, 2008.
Shukla et al. "The Role of MicroRNAs and Other Endogenous Small RNAs in Plant Stress Responses", Biochimica et Biophysica Acta, BBA—Gene Regulatory Mechanisms, XP025626372, 1779(11): 743-748, Nov. 1, 2008.
Sunkar et al. "Novel and Stress-Regulated MicroRNAs and Other Small RNAs From *Arabidopsis*", The Plant Cell, 16: 2001-2019, Aug. 2004.
Sunkar et al. "Small RNAs as Big Players in Plant Abiotic Stress Responses and Nutrient Deprivation", Trends in Plant Science, XP022148764, 12(7): 301-309, Jul. 1, 2007.
Zhang et al. "Over-Expression of MicroRNA169 Confers Enhanced Drought Tolerance to Tomato", Biotechnology Letters, 33(2): 403-409, Oct. 20, 2010.
Zhao et al. "Identification of Drought-Induced MicroRNAs in Rice", Biochemical and Biophysical Research Communications, BBRC, XP005737662, 354: 585-590, 2007.
Zhao et al. "Members of MiR-169 Family Are Induced by High Salinity and Transiently Inhibit the Nf—Ya Transcription Factor", BMC Molecular Biology, XP002637526, 10(29): 1-10, Apr. 8, 2009.
Zhou et al. "Genome-Wide Identification and Analysis of Drought-Responsive MicroRNAs in *Oryza saliva*", Journal of Experimental Botany, XP002628343, 61(15): 4157-4168, 2010.
International Preliminary Report on Patentability Dated Jun. 21, 2012 From the International Bureau of WIPO Re. Application No. PCT/IB2010/055600.
Office Action Dated Jan. 19, 2015 From the Israel Patent Office Re. Application No. 220222.
Translation Dated Feb. 1, 2015 of Office Action Dated 19 Jan. 2015 From the Israel Patent Office Re. Application No. 220222.

Altenbach et al., "Accumulation of a Brazil nut albumin in seeds of transgenic canola results in enhanced levels of seed protein methionine," *Plant Mol. Biol.*, 18:235-245 (1992).
Baszczynski et al., "Isolation and nucleotide sequence of a genomic clone encoding a new Brassie napus napin gene," *Plant Mol. Biol.*, 14:633-635 (1990).
Buchholz et al., "Cyclophilins are encoded by a small gene family in rice," *Plant Mol. Biol.*, 25(5):837-843 (1994).
Cho et al., "Inheritance of tissue-specific expression of barley hordein promoter-uidA fusions in transgenic barley plants," *Theor Appl Genet*, 98:1253- 1262 (1999).
Christensen et al., "Maize polyubiquitin genes: structure, thermal perturbation of expression and transcript splicing, and promoter activity following transfer to protoplasts by electroporation," *Plant Mol. Biol.*, 18:675-689 (1992).
Colot et al., "Molecular characterization of an active wheat LMW glutenin gene and its relation to other wheat and barley prolamin genes," *Mol. Gen. Genet.*, 216:81-90 (1989).
Cummins et al., "cDNA sequence of a sunflower oleosin and transcript tissue specificity," *Plant Mol. Biol.*, 19:873-876 (1992).
Dawson et al., "A Tobacco Mosaic Virus-Hybrid. Expresses and Loses an Added Gene," *Virology*, 172:285-292 (1989).
DeRose et al., "Analysis of kafirin promoter activity in transgenic tobacco seeds," *Plant Mol. Biol.*, 32:1029-35 (1996).
Ellis et al., "Tissue-specific expression of a pea legumin gene in seeds of *Nicotiana plumbaginifolia*," *Plant Mol. Biol.*, 10:203-214 (1988).
Franco-Zorilla et al., "Target mimicry provides a new mechanism for regulation of microRNA activity," *Nature Genetics*, 39(8):1033-10371 (2007).
Fromm et al., "Stable transformation of maize after gene transfer by electroporation," *Nature*, 319:791-793 (1986).
Helliwell et al., "Constructs and methods for high-throughput gene silencing in plants," *Methods*, 30:289-295 (2003).
Jorgensen et al., "Chalcone synthase cosuppression phenotypes in petunia flowers: comparison of sense vs. antisense constructs and single-copy vs. complex T-DNA sequences," *Plant Mol. Biol.*, 31:957-973 (1996).
Klee et al., "Agrobacterium-Mediated Plant Transformation and it's Further Applications to Plant Biology," *Annu. Rev. Plant Physiol.*, 38:467-486 (1987).
Klein et al., "Factors Influencing Gene Delivery into *Zea mays* Cells by High-Velocity Microprojectiles," *Bio/Technology*, 6:559-563 (1988).
Kurihara et al., "Cross-protection in *Arabidopsis* against crucifer tobamovirus Cg by an attenuated strain of the virus," *Molecular Plant Pathology*, 4(4):259- 269 (2003).
Last et al., "pEmu: an improved promoter for gene expression in cereal cells," *Theor. Appl. Genet.*, 81:581-588 (1991).
Lepetit et al., "A plant histone gene promoter can direct both replication-dependent and -independent gene expression in transgenic plants," *Mol. Gen. Genet.*, 231:276-285 (1992).
Matzke et al., "Deletion analysis of a zein gene promoter in transgenic tobacco plants," *Plant Mol. Biol.*, 143:323-32 (1990).
McCabe et al., "Stable Transformation of Soybean (*Glycine max*) by Particle Acceleration," *Bio/Technology*, 6:923-926 (1988).
Nakase et al., "Characterization of a novel rice bZIP protein which binds to the a-globulin promoter," *Plant Mol. Biol.*, 33:513-522 (1997).
Neuhaus et al., "Plant transformation by microinjection techniques," *Physiologia Plantarum*, 79:213-217 (1990).
Neuhaus et al., "Transgenic rapeseed plants obtained by the microinjection of DNA into microspore-derived embryoids," *Theor. Appl. Genet.*, 75:30-36 (1987).
Nilsson et al., "The Agrobacterium rhizogenes rolB and rolC promoters are expressed in pericycle cells competent to serve as root initials in transgenic hybrid aspen," *Physiolgia Plantarum*, 100:456-462 (1997).
Odell et al., "Identification of DNA sequences required for activity of the cauliflower mosaic virus 35S promoter," *Nature*, 313:810-812 (1985).

(56) References Cited

OTHER PUBLICATIONS

Orozco et al., "Localization of light-inducible and tissue-specific regions of the spinach ribulose bisphosphate carboxylase/oxygenase (rubisco) activase promoter in transgenic tobacco plants," *Plant Mol. Biol.*, 23:1129-1138 (1993).

Panstruga et al., "Testing the efficiency of dsRNAi constructs in vivo: A transient expression assay based on two fluorescent proteins," *Mol. Biol. Rep.*, 30:135-150 (2003).

Pelleschi et al.,"*Ivr2*, a candidate gene for a QTL of vacuolar invertase activity in maize leaves. Gene-specific expression under water stress," *Plant Mol. Biol.*, 39:373-380 (1999).

Postma-Haarsma at al., "Developmental regulation and downstream effects of the knox class homeobox genes Oskn2 and Oskn3 from rice," *Plant Mol. Biol.*, 39:257-71 (1999).

Potrykus, "Gene Transfer to Plants: Assessment of Published Approaches and Results," *Annu. Rev. Plant. Physiol & Plant. Mol. Biol.*, 42:205-225 (1991).

Russell et al., "Tissue-specific expression in transgenic maize of four endosperm promoters from maize and rice," *Transgenic Research*, 6:157-168 (1997).

Sanford, "Biolistic plant transformation," *Physiologia Plantarum*, 79:206-209 (1990).

Shimamoto et al., "Fertile transgenic rice plants regenerated from transformed protoplasts," *Nature*, 338:274-276 (1989).

Simon et al., "Nucleotide sequence of a cDNA close of *Brassica napus* 12S storage protein shows homology with legumin from Pisum sativum," *Plant Mol. Biol.*, 5:191-201 (1985).

Smith et al., "Gene Expression : Total silencing by intron-spliced hairpin RNAs," *Nature*, 407:319-320 (2000).

Sørensen et al., "Hordein promoter methylation and transcriptional activity in wild-type and mutant barley endosperm," *Mol Gen Genet.*, 250:750-760 (1996).

Stalberg et al., "Disruption of an overlapping E-box/ABRE motif abolished high transcription of the napA storage-protein promoter in transgenic *Brassica napus* seeds," *Planta*, 199:515-519 (1996).

Takaiwa et al., "A rice glutelin gene family—A major type of glutelin mRNAs can be divided into two classes," *Mol. Gen. Genet.*, 208:15-22 (1987).

Takamatsu et al., "Expression of bacterial chloramphenicol acetyltransferase gene in tobacco plants mediated by TMV-RNA," *The EMBO Journal*, 6(2):307- 311 (1987).

Toriyama et al., "Transgenic Rice Plants After Direct Gene Transfer Into Protoplasts," *Bio/Technology*, 6:1072-1074 (1988).

Twell et al., "Isolation and expression of an anther-specific gene from tomato," *Mol. Gen Genet.*, 217:240-245 (1989).

van der Meer et al., "Promoter analysis of the chalcone synthase (*chs* A) gene of *Petunia hybrida*: a 67 by promoter region directs flower-specific expression," *Plant Mol. Biol.*, 15:95-109 (1990).

Wang et al., "Application of gene silencing in plants," *Curr. Opin. Plant Biol.*, 5:146-150 (2001).

Waterhouse et al., "Exploring Plant Genomes by RNA-Induced Gene Silencing," *Nat. Rev. Genet.*, 4:29-38 (2003).

Yamaguchi-Shinozalei et al., "Characterization of the expression of a desiccation-responsive *rd29* gene of *Arabidopsis thaliana* and analysis of its promoter in transgenic plants," *Mol. Gen. Genet.*, 236:331-340 (1993).

Yamamoto et al., "The Promoter of a Pine Photosynthetic Gene Allows Expression of a β-Glucuronidase Reporter Gene in Transgenic Rice Plants in a Light-Independent but Tissue-Specific Manner," *Plant Cell Physiol.*, 35(5):773-778 (1994).

Yu et al., "Metabolic engineering to increase isoflavone biosynthesis in soybean seed," *Phytochemistry*, 63:753-763 (2003).

Zhang et al., "Transgenic rice plants produced by electroporation-mediated plasmid uptake into protoplasts," *Plant Cell Rep.*, 7:379-384 (1988).

\* cited by examiner

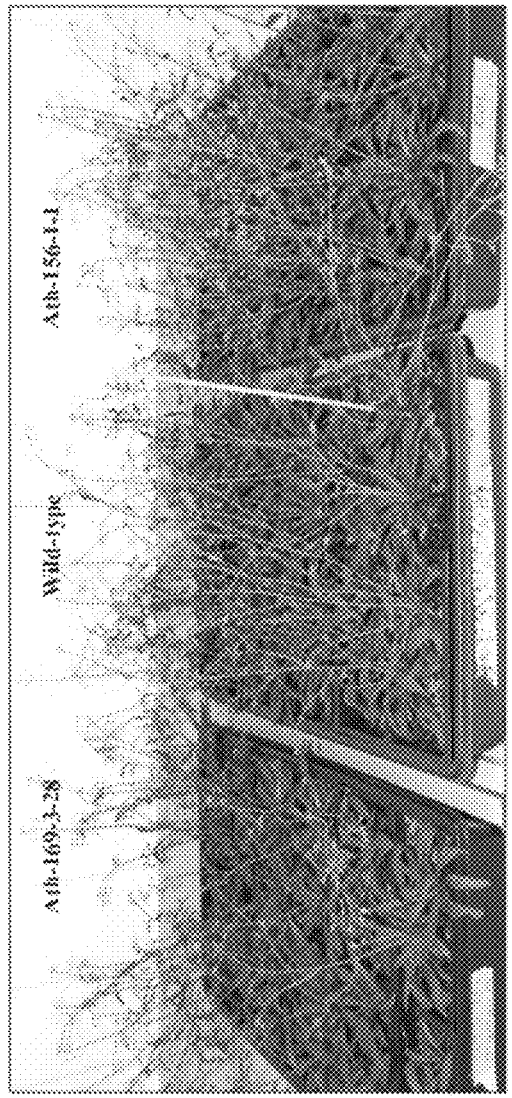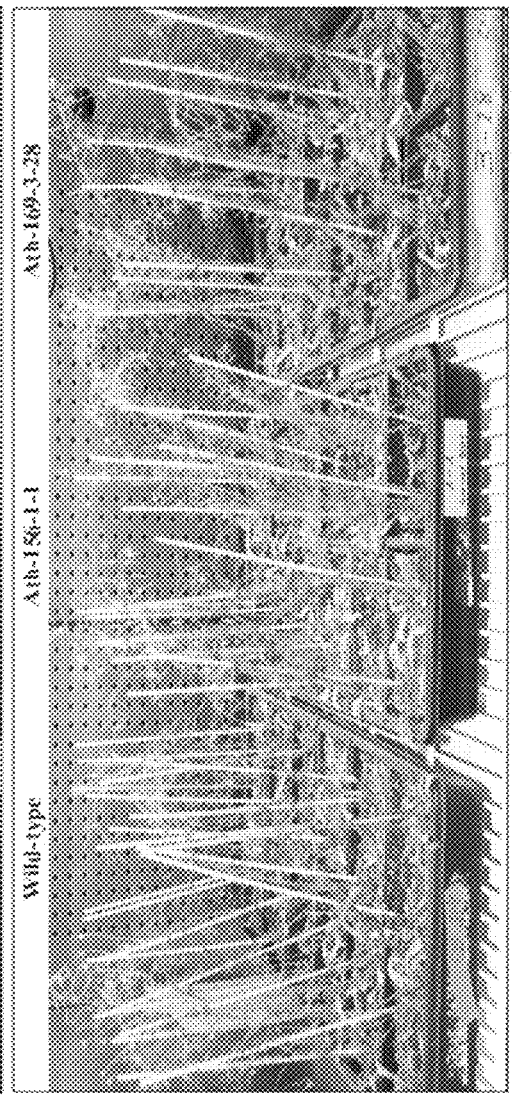

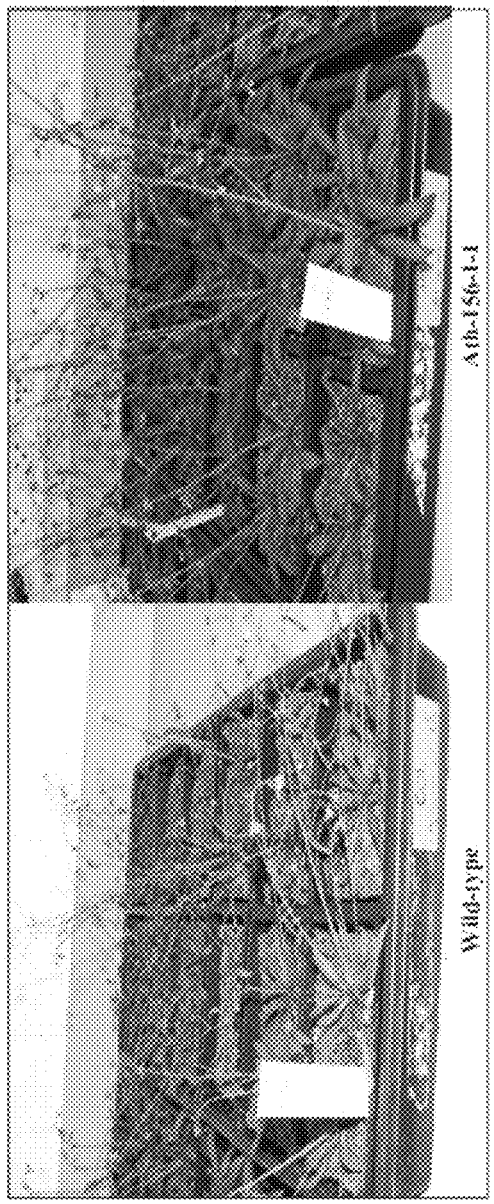
FIG. 5A
FIG. 5B
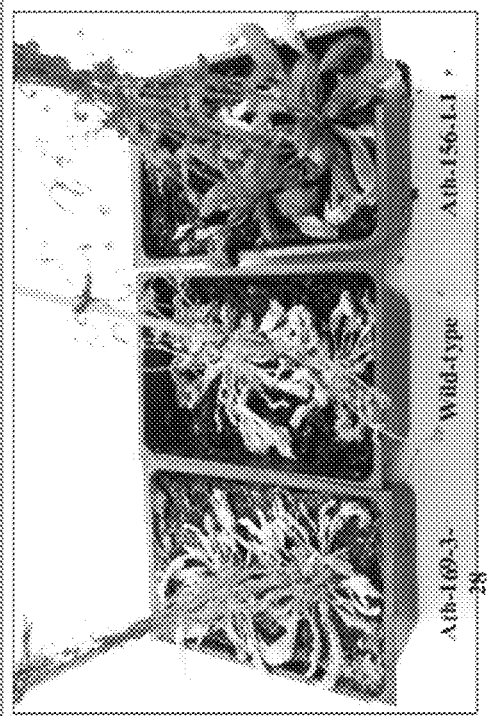
FIG. 5C

MICRORNA COMPOSITIONS AND METHODS FOR ENHANCING PLANT RESISTANCE TO ABIOTIC STRESS

RELATED APPLICATIONS

This application is a National Phase of PCT Patent Application No. PCT/IB2010/055600 having International filing date of Dec. 6, 2010, which claims the benefit of priority of U.S. Provisional Patent Application No. 61/267,052 filed on Dec. 6, 2009. The contents of the above applications are all incorporated herein by reference.

FIELD AND BACKGROUND OF THE INVENTION

The present invention, in some embodiments thereof, relates to microRNAs and, more particularly, but not exclusively, to the use of same or alteration of same for generation of plants with enhanced resistance to abiotic stress.

MicroRNAs (miRNAs) are small, endogenous RNAs that regulate gene expression in plants and animals. In plants, they are processed from stem-loop regions of long primary transcripts by a Dicer-like enzyme and are loaded into silencing complexes, where they generally direct cleavage of complementary mRNAs. Although plant miRNAs have some conserved functions extending beyond development, the importance of miRNA-directed gene regulation during plant development is now becoming clear. mRNAs are already known to play numerous crucial roles at each major stage of development, typically at the core of gene regulatory networks, targeting genes that are themselves regulators. So far, microRNAs have been found to be involved in plant development, regulation of abiotic and biotic stress responses and hormone signaling (Jones-Rhoades et al., 2006, Ann Rev Plant Biol 57:19-53).

A commonly-used approach in identifying the function of novel genes is through loss-of-function mutant screening. In many cases, functional redundancy exists between genes that are members of the same family. When this happens, a mutation in one gene member might have a reduced or even non-existing phenotype and the mutant lines might not be identified in the screening.

Using microRNAs, multiple members of the same gene family can be silenced simultaneously, giving rise to much more intense phenotypes. This approach is also superior to RNA interference (RNAi) techniques, in which typically 100-800 by fragments of the gene of interest form a fold-back structure when expressed. These long fold-back RNAs form many different small RNAs and prediction of small RNA targets other than the perfectly complementary intended targets is therefore very difficult. MicroRNAs, in contrast, are produced from precursors, which are normally processed such that preferentially one single, stable small RNA is generated, thus significantly minimizing the "off-target" effect.

A second approach to functional screening is through over-expression of genes of interest and testing for their phenotypes. In many cases, attempting to over-express a gene which is under microRNA regulation results in no significant increase in the gene transcript. This can be overcome either by expressing a microRNA-resistant version of the gene or by down-regulating the microRNA itself.

Abiotic stress refers to such conditions as water deficit or drought, heat, cold, high or low nutrient or salt levels, and high or low light levels. In particular, drought and salinity are serious problems in agriculture and result in annual yield losses of billions of dollars worldwide. Many genes are involved in the responses to abiotic stress to in plants, but there is only limited information on miRNAs involved in plant response and adaptation to abiotic stress.

With a growing world population, increasing demand for food, fuel and fiber, and a changing climate, agriculture faces unprecedented challenges. In any given year, large areas of cornfields in the United States may be affected by at least moderate drought. Farmers are seeking advanced, biotechnology-based solutions to enable them to obtain stable high yields and give them the potential to reduce irrigation costs or to grow crops in areas where potable water is a limiting factor.

SUMMARY OF THE INVENTION

According to an aspect of some embodiments of the present invention there is provided a method of increasing tolerance of a plant to an abiotic stress or increasing biomass, vigor or yield of a plant, the method comprising upregulating within the plant an exogenous polynucleotide of a microRNA or a precursor thereof, wherein the microRNA is selected from the group consisting of miR-156, miR-169, miR-164, miR-159, miR-167, miR-529, miR-168, ppt-miR395, sof-miR408a, ath-miR408, miR-1039, miR-1091, miR-1118, miR-1134 and miR-1129, thereby increasing the tolerance of the plant to the abiotic stress or increasing the biomass, vigor or yield of the plant.

According to an aspect of some embodiments of the present invention there is provided a method of increasing tolerance of a plant to an abiotic stress or increasing biomass, vigor or yield of a plant, the method comprising expressing within the plant an exogenous polynucleotide encoding a nucleic acid agent capable of down-regulating expression of a target gene of a microRNA or a precursor thereof, wherein the microRNA is selected from the group consisting of miR-156, miR-169, miR-164, miR-159, miR-167, miR-529, miR-168, ppt-miR395, sof-miR408a, ath-miR408, miR-1039, miR-1091, miR-1118, miR-1134 and miR-1129, thereby increasing the tolerance of the plant to the abiotic stress or increasing the biomass, vigor or yield of the plant.

According to an aspect of some embodiments of the present invention there is provided a method of increasing tolerance of a plant to an abiotic stress or increasing biomass, vigor or yield of a plant, the method comprising expressing within the plant an exogenous polynucleotide encoding a nucleic acid agent capable of down-regulating expression or activity of a microRNA or a precursor thereof, wherein the microRNA is selected from the group consisting of miR-171, miR-172, miR-399, miR-854, miR-894, miR-160, miR-166, miR-390, ath-miR395a, smo-miR408, miR-397, miR-477, miR-528, miR-530, miR-535, miR-855, miR-894, miR-896, miR-901 and miR-1026, thereby increasing the tolerance of the plant to the abiotic stress or increasing the biomass, vigor or yield of the plant.

According to an aspect of some embodiments of the present invention there is provided a method of increasing tolerance of a plant to an abiotic stress or increasing biomass, vigor or yield of a plant, the method comprising expressing within the plant an exogenous polynucleotide for upregulating expression of a target gene of a microRNA or a precursor thereof, wherein the microRNA is selected from the group consisting of miR-171, miR-172, miR-399, miR-854, miR-894, miR-160, miR-166, miR-390, ath-miR395a, smo-miR408, miR-397, miR-477, miR-528, miR-530, miR-535, miR-855, miR-894, miR-896, miR-901 and miR-1026, thereby increasing the tolerance of the plant to the abiotic stress or increasing the biomass, vigor or yield of the plant.

According to an aspect of some embodiments of the present invention there is provided a nucleic acid construct, comprising a polynucleotide at least 90% homologous to a nucleic acid sequence selected from the group consisting of miR-156, miR-169, miR-164, miR-159, miR-167, miR-529, miR-168, ppt-miR395, sof-miR408a, ath-miR408, miR-1039, miR-1091, miR-1118, miR-1134 and miR-1129 or a precursor thereof, wherein the nucleic acid sequence is under a transcriptional control of at least one promoter capable of directing transcription of the polynucleotide in a host cell.

According to an aspect of some embodiments of the present invention there is provided a nucleic acid construct, comprising a polynucleotide at least 90% homologous to a nucleic acid sequence selected from the group consisting of a target gene of miR-171, a target gene of miR-172, a target gene of miR-399, a target gene of miR-854, a target gene of miR-894, a target gene of miR-160, a target gene of miR-166, a target gene of miR-390, a target gene of ath-miR395a, a target gene of smo-miR408, a target gene of miR-397, a target gene of miR-477, a target gene of miR-528, a target gene of miR-530, a target gene of miR-535, a target gene of miR-855, a target gene of miR-894, a target gene of miR-896, a target gene of miR-901 and a target gene of miR-1026, wherein the nucleic acid sequence is under a transcriptional control of at least one promoter capable of directing transcription of the polynucleotide in a host cell.

According to an aspect of some embodiments of the present invention there is provided a nucleic acid construct, comprising a nucleic acid sequence for down-regulating an expression of a target gene of a microRNA or a precursor thereof, wherein the target gene of the microRNA is selected from the group consisting of a target gene of miR-156, a target gene of miR-169, a target gene of miR-164, a target gene of miR-159, a target gene of miR-167, a target gene of miR-529, a target gene of miR-168, a target gene of ppt-miR395, a target gene of sof-miR408a, a target gene of ath-miR408, a target gene of miR-1039, a target gene of miR-1091, a target gene of miR-1118, a target gene of miR-1134 and a target gene of miR-1129, wherein the nucleic acid sequence is under a transcriptional control of at least one promoter capable of directing transcription of the polynucleotide in a host cell.

According to an aspect of some embodiments of the present invention there is provided a nucleic acid construct, comprising a nucleic acid sequence for down-regulating an expression of a microRNA or a precursor thereof, wherein the microRNA is selected from the group consisting of miR-171, miR-172, miR-399, miR-854, miR-894, miR-160, miR-166, miR-390, ath-miR395a, smo-miR408, miR-397, miR-477, miR-528, miR-530, miR-535, miR-855, miR-894, miR-896, miR-901 and miR-1026, wherein the nucleic acid sequence is under a transcriptional control of at least one promoter capable of directing transcription of the polynucleotide in a host cell.

According to an aspect of some embodiments of the present invention there is provided a plant cell, or a plant or a portion thereof, comprising a nucleic acid nucleic acid construct comprising (i) a polynucleotide at least 90% homologous to a nucleic acid sequence selected from the group consisting of miR-156, miR-169, miR-164, miR-159, miR-167, miR-529, miR-168, ppt-miR395, sof-miR408a, ath-miR408, miR-1039, miR-1091, miR-1118, miR-1134 and miR-1129 or a precursor thereof, where the nucleic acid sequence is under a transcriptional control of at least one promoter capable of directing transcription of the polynucleotide in a host cell; or (ii) a polynucleotide at least 90% homologous to a nucleic acid sequence selected from the group consisting of a target gene of miR-171, a target gene of miR-172, a target of miR-399, a target gene of miR-854, a target gene of miR-894, a target gene of miR-160, a target gene of miR-166, a target gene of miR-390, a target gene of ath-miR395a, a target gene of smo-miR408, a target gene of miR-397, a target gene of miR-477, a target gene of miR-528, a target gene of miR-530. a target gene of miR-535. a tarcet aene of miR-855. a target gene of miR-894. a target gene of miR-896. a target gene of miR-901 and a target gene of miR- 1026. where the nucleic acid sequence is under a transcriptional control of at least one promoter capahle of directing transcription of the polynucleotide in a host cell: or lml a nucleic acid sequence for down-regulating an expression of a target gene of a microRNA Of a precursor thereof, where the, target gene of the microRNA is selected frgm the grpup consoling of a target gene of mi K-150 . a target gene of miK-169. a target gene of miR-164. a target gene of miR-159. a target gene of miR-167. a target gene of miR-529. a target gene of miR-168. a target gene of ppt- miR395, a target gene of sof-roiR408a. a target gene of ath-miR4Q8. a target gene of miR-1039. a target gene of miR-1091. a target gene of miR-1118a target gene of miR-1134. and a target gene of miR-1129 where the nucleic acid sequence is under a transcriptional control of al least one promoter capable of directing transcription of the notvnucleotide in a host cell, or (jvl a nucleic acid sequence for down-regulating expression of a microRNA or a precursor thereof, where the According to some embodiments of the invention, the upregulating is effected by expressing within the plant the exogenous polynucleotide of the microRNA or the precursor thereof.

According to some embodiments of the invention, the method comprises growing the plant under abiotic stress conditions.

According to some embodiments of the invention, the abiotic stress is selected from the group consisting of salinity, water deprivation, low temperature, high temperature, heavy metal toxicity, anaerobiosis, nutrient deficiency, nutrient excess, atmospheric pollution and UV irradiation.

According to some embodiments of the invention, the expressing is effected by transforming a cell of the plant with the exogenous polynucleotide.

According to some embodiments of the invention, the transforming is effected by introducing into the cell of the plant a nucleic acid construct including the exogenous polynucleotide and at least one promoter capable of directing transcription of the exogenous polynucleotide in the cell of the plant.

According to some embodiments of the invention, the expressing is effected by infecting the plant with a bacteria comprising the exogenous polynucleotide.

According to some embodiments of the invention, the downregulating activity of the microRNA is effected by introducing into the plant a target mimic or a micro-RNA resistant target which is not cleaved by the microRNA.

According to some embodiments of the invention, the target mimic or the micro-RNA resistant target is essentially complementary to the microRNA provided that one or more of following mismatches are allowed:

(a) a mismatch between the nucleotide at the 5' end of the microRNA and the corresponding nucleotide sequence in the target mimic or the micro-RNA resistant target;

(b) a mismatch between any one of the nucleotides in position 1 to position 9 of the microRNA and the corresponding nucleotide sequence in the target mimic or the micro-RNA resistant target; or (c) three mismatches between any one of the nucleotides in position 12 to position 21 of the microRNA and the corresponding nucleotide sequence in the target mimic or the micro-RNA resistant target provided that there are no more than two consecutive mismatches.

According to some embodiments of the invention, the target mimic or the micro-RNA resistant target is introduced into a cell of the plant in a nucleic acid construct including a target gene and at least one promoter capable of directing transcription of the target polynucleotide in the cell of the plant.

According to some embodiments of the invention, the target gene of the microRNA is as set forth in SEQ ID NOs: 195-341, 474-485.

According to some embodiments of the invention, the host cell comprises a plant cell.

According to some embodiments of the invention, the target gene of miR-169 comprises a NF-YA8 protein.

According to some embodiments of the invention, the miR-156 is selected from the group consisting of bna-miR156a, smo-miR156c, sbi-miR156d, smo-miR156d, vvi-miR156e, ath-miR156g, ptc-miR156k, zma-miR156k and osa-miR156l.

According to some embodiments of the invention, the miR-169 is selected from the group consisting of ath-miR169a, osa-miR169a, sbi-miR169b, bna-miR169c, sbi-miR169c, ath-miR169d, osa-miR169e, bna-miR169g, sbi-miR169i, bna-miR169m, vvi-miR169m, ptc-miR169o, ptc-miR169q, ptc-miR169v and ptc-miR169x.

According to some embodiments of the invention, the miR-164 is selected from the group consisting of osa-miR164a, sbi-miR164b, osa-miR164c, osa-miR164e and ptc-miR164f.

According to some embodiments of the invention, the miR-167 is selected from the group consisting of ppt-miR167, bna-miR167a, ath-miR167c, ath-miR167d, ptc-miR167f and ptc-miR167h.

According to some embodiments of the invention, the miR-1039 comprises ppt-miR1039-3p.

According to some embodiments of the invention, the miR-168 is selected from the group consisting of sbi-miR168 and gma-miR168.

According to some embodiments of the invention, the miR-159 is selected from the group consisting of pta-miR159c, sof-miR159c, osa-miR159c and osa-miR159d.

According to some embodiments of the invention, the miR-529 is selected from the group consisting of ppt-miR529a, ppt-miR529d, ppt-miR529e and ppt-miR529g.

According to some embodiments of the invention, the miR-1118 comprises tae-miR1118.

According to some embodiments of the invention, the miR-1134 comprises tae-miR1134.

According to some embodiments of the invention, the miR-1129 comprises tae-miR1129.

According to some embodiments of the invention, the miR-1091 comprises smo-miR1091.

According to some embodiments of the invention, the miR-171 is selected from the group consisting of smo-miR171a, vvi-miR171a, ath-miR171b, sbi-miR171b, smo-miR171b, zma-miR171c, sbi-miR171e, sbi-miR171f, zma-miR171f and vvi-miR171i.

According to some embodiments of the invention, the miR-172 is selected from the group consisting of gma-miR172a, ath-miR172c and zma-miR172e.

According to some embodiments of the invention, the miR-854 comprises ath-miR854a.

According to some embodiments of the invention, the miR-894 comprises ppt-miR894.

According to some embodiments of the invention, the miR-160 is selected from the group consisting of ppt-miR160b and ppt-miR160c.

According to some embodiments of the invention, the miR-390 is selected from the group consisting of osa-miR390 and ppt-miR390c.

According to some embodiments of the invention, the miR-399 is selected from the group consisting of sbi-miR399a, sbi-miR399b and mtr-miR399d.

According to some embodiments of the invention, the miR-166 comprises sbi-miR166e.

According to some embodiments of the invention, the miR-397 is selected from the group consisting of bna-miR397a and ptc-miR397b.

According to some embodiments of the invention, the miR-477 comprises ppt-miR477a-3p.

According to some embodiments of the invention, the miR-528 comprises osa-miR528.

According to some embodiments of the invention, the miR-530 comprises osa-miR530-3p.

According to some embodiments of the invention, the miR-535 comprises vvi-miR535a.

According to some embodiments of the invention, the miR-855 comprises ath-miR855.

According to some embodiments of the invention, the miR-896 comprises ppt-miR896.

According to some embodiments of the invention, the miR-901 comprises ppt-miR901.

According to some embodiments of the invention, the miR-1026 comprises ppt-miR1026a.

According to some embodiments of the invention, the portion comprises a plant seed.

According to some embodiments of the invention, the plant is a dicotyledonous plant.

According to some embodiments of the invention, the plant is a monocotyledonous plant.

According to some embodiments of the invention, the plant comprises corn.

According to some embodiments of the invention, the plant comprises *sorghum*.

According to some embodiments of the invention, the plant is selected from the group consisting of *Arabidopsis, sorghum*, corn, tobacco, cauliflower, soybean, alfalfa, peach, white spruce, wheat, sugar beet, sunflower, sugarcane, cotton, barley, tomato, potato, oat, carrot and grape.

Unless otherwise defined, all technical and/or scientific terms used herein have the same meaning as commonly understood by one of ordinary skill in the art to which the invention pertains. Although methods and materials similar or equivalent to those to described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIG. 1 shows a target-mimic sequence which could potentially be targeted by a miRNA, but contains extra nucleotides, leading to the creation of a bulge at a position sensitive to mismatches (see further explanation in Example 6 of the Examples section which follows).

FIGS. 2A-B are photographs depicting miR-156a (SEQ ID NO: 191) and miR-169a (SEQ ID NO: 12) transgenic *Arabidopsis thaliana* plants comprising enhanced drought tolerance compared to wild-type plants. FIG. 2A depicts control (watered) trays; and FIG. 2B shows plants after 10 days of de-hydration.

Figures 3A, 3B:
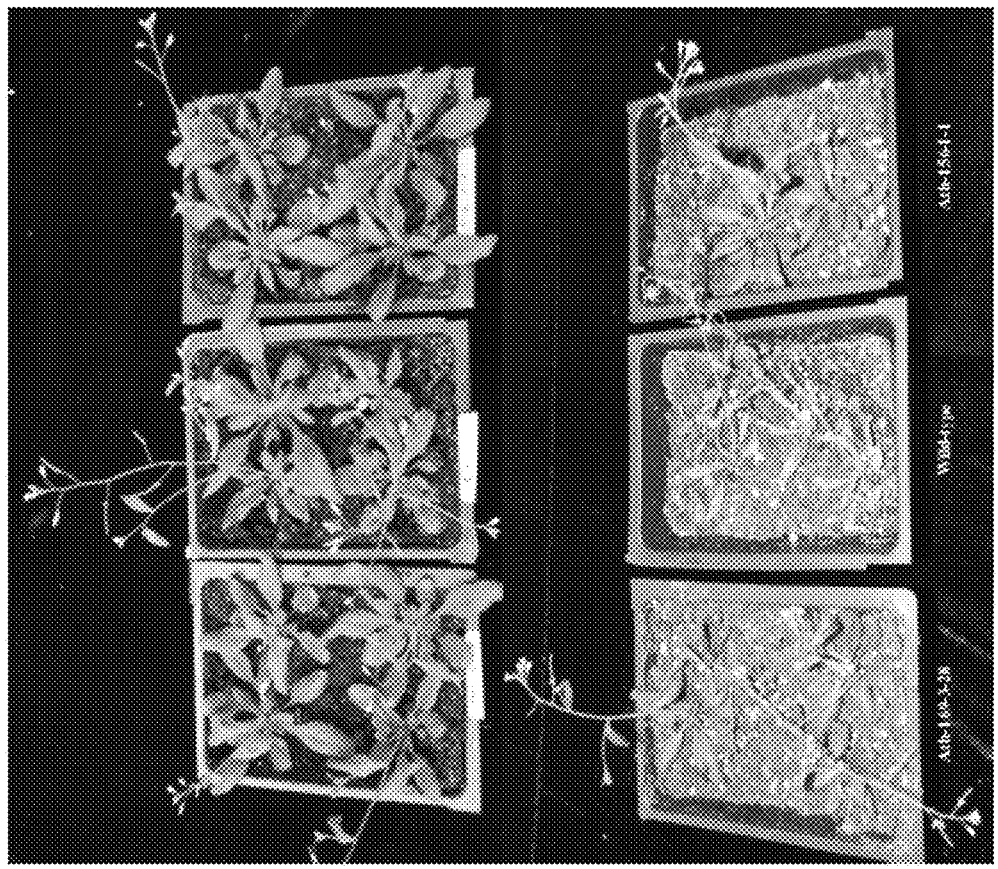

FIGS. 3A-B are photographs depicting miR-156a (SEQ ID NO: 191) and miR-169a (SEQ ID NO: 12) transgenic *Arabidopsis thaliana* plants comprising enhanced drought tolerance compared to wild-type plants. FIG. 3A depicts control (watered) trays; and FIG. 3B shows plants after 10 days of de-hydration.

Figure 4:
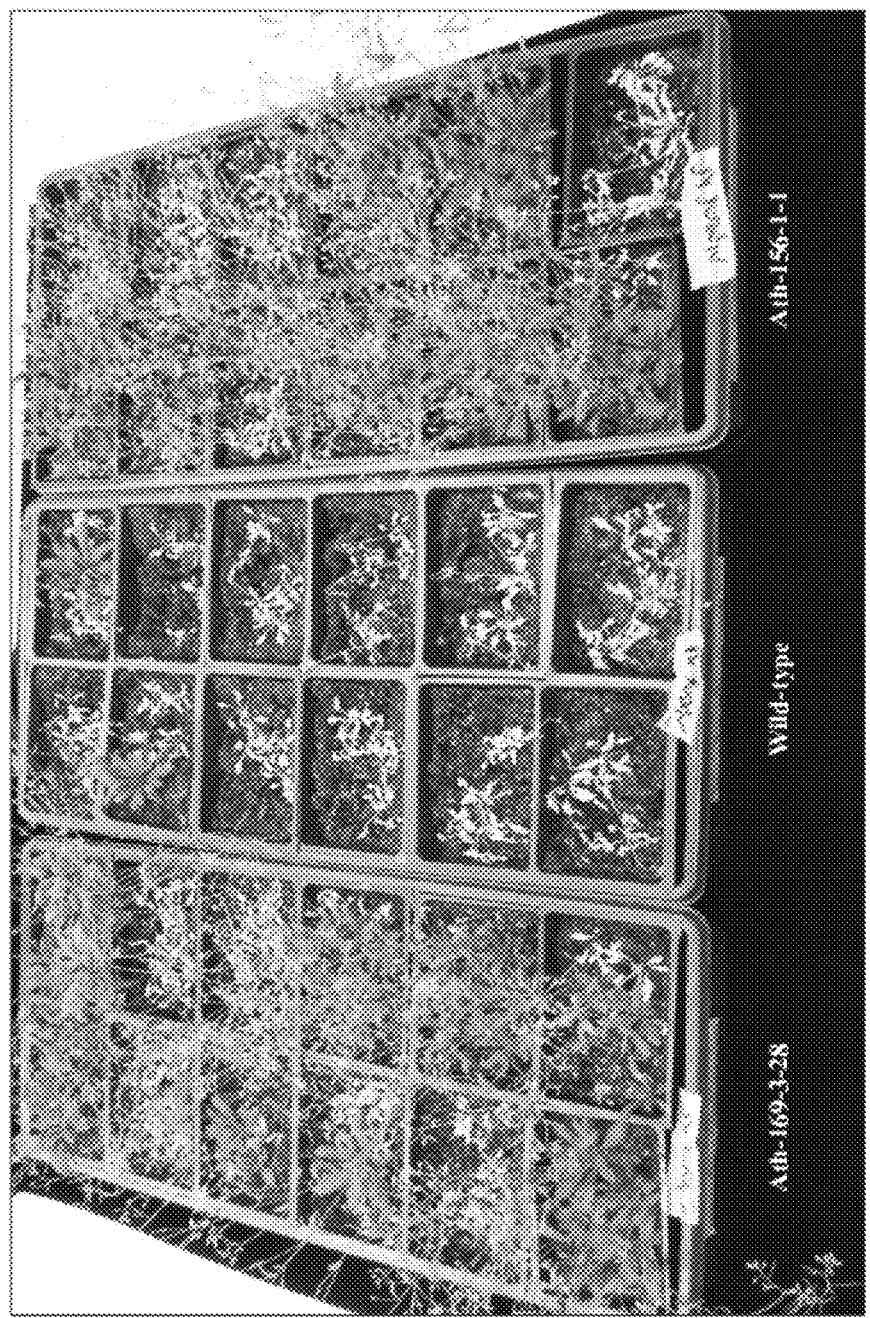

FIG. 4 is a photograph depicting miR-156a (SEQ ID NO: 191), miR-169a (SEQ ID NO: 12) and wild-type *Arabidopsis thaliana* plants watered after 10 days of de-hydration. The photograph was taken after 7 days of regeneration. Of note, wild-type plants did not survive while transgenic plants survived and displayed characteristics similar to the watered plants.

FIGS. 5A-C are photographs depicting miR-156a (SEQ ID NO: 191), miR-169a (SEQ ID NO: 12) and wild-type *Arabidopsis thaliana* plants watered after 10 days of to de-hydration. FIGS. 5A-B depict trays of mature wild-type and transgenic plants after 10 days of drought. FIG. 5C depicts single pots from the same experiment. Of note, wild-type plants did not survive while transgenic plants survived and displayed characteristics similar to the watered plants.

Figure 6A:
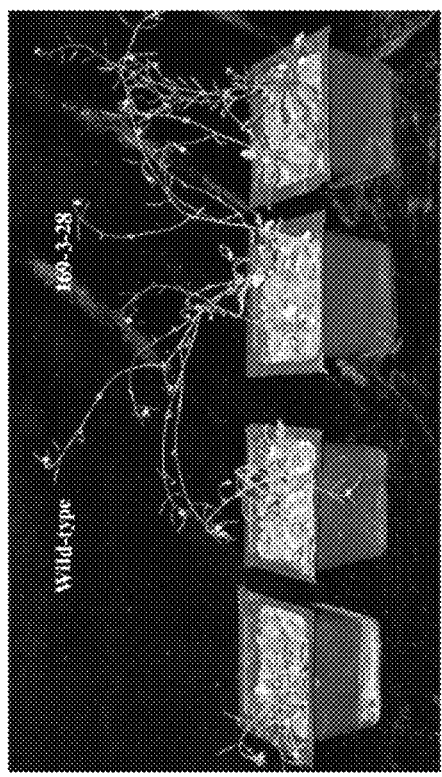
Figure 6B:
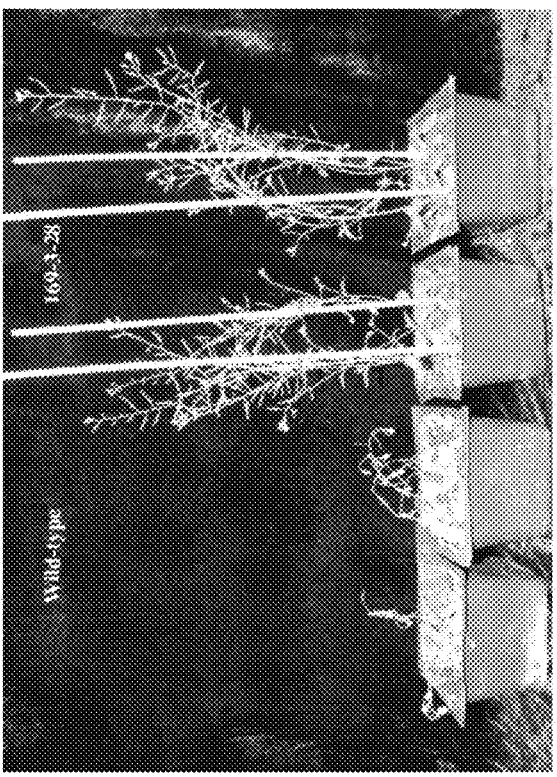

FIGS. 6A-B are photographs depicting miR-169a (SEQ ID NO: 12) and wild-type *Arabidopsis thaliana* plants. FIG. 6A depicts the transgenic and wild-type plants after a 10 day drought; and FIG. 6B depicts the transgenic and wild-type plants after 7 days of re-hydration (following the drought).

DESCRIPTION OF SPECIFIC EMBODIMENTS OF THE INVENTION

The present invention, in some embodiments thereof, relates to microRNAs and, more particularly, but not exclusively, to the use of same or alteration of same for generation of plants with enhanced resistance to abiotic stress.

The principles and operation of the present invention may be better understood with reference to the drawings and accompanying descriptions.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways. Also, it is to be understood that the phraseology and terminology employed herein is for the purpose of description and should not be regarded as limiting.

While reducing some embodiments of the present invention to practice, the present inventor has uncovered novel microRNA molecules involved in enhanced tolerance of plants to abiotic stress. Moreover, the present inventor has constructed nucleic acid vectors expressing these microRNAs and used same for generating transgenic plants with enhanced tolerance to abiotic stress.

Thus, as shown in the Examples section which follows, the present inventor has grown corn and *sorghum* under abiotic stress conditions (drought or high salinity) and analyzed, by high throughput microarray and PCR, the differential expression levels of microRNAs in these plants. Specifically, the present inventor has unveiled specific microRNAs which are upregulated or downregulated in response to abiotic stress conditions such as drought and salinity (see Tables 2-5, in the Examples section which to follows) and revealed possible target peptides of these microRNAs (see Tables 6-7, in the Examples section which follows).). Moreover, the present inventor has generated transgenic *Arabidopsis thaliana* plants expressing miR-156a or miR-169a which can withstand severe drought and continue to grow and thrive similarly to watered plants the plants appear less dry then the control throughout the de-hydration, and after the re-hydration the plants are able to recover and continue to grow and flower, while the wild-type either does not survive or is unable to develop properly. (see FIGS. 2A-B, 3A-B, 4, 5A-C and 6A-B). Accordingly, these microRNAs and their specific target genes may serve as powerful tools in the field of agriculture transgenic technologies.

As used herein the term "tolerance" refers to the ability of a plant to endure an abiotic stress without exhibiting substantial physiological or physical damage (e.g. alteration in metabolism, growth, viability and/or reproductivity of the plant).

The phrase "abiotic stress" as used herein refers to any adverse effect on metabolism, growth, viability and/or reproduction of a plant. Abiotic stress can be induced by any of suboptimal environmental growth conditions such as, for example, water deficit or drought, flooding, freezing, low or high temperature, strong winds, heavy metal toxicity, anaerobiosis, high or low nutrient levels (e.g. nutrient deficiency), high or low salt levels (e.g. salinity), atmospheric pollution, high or low light intensities (e.g. insufficient light) or UV irradiation. Abiotic stress may be a short term effect (e.g. acute effect, e.g. lasting for about a week) or alternatively may be persistent (e.g. chronic effect, e.g. lasting for example 10 days or more). The present invention contemplates situations in which there is a single abiotic stress condition or alternatively situations in which two or more abiotic stresses occur.

According to an exemplary embodiment the abiotic stress refers to salinity.

According to another exemplary embodiment the abiotic stress refers to drought.

As used herein the phrase "biomass of a plant" or "plant biomass" refers to the amount (e.g., measured in grams of air-dry tissue) of a tissue produced from the plant in a growing season. An increase in plant biomass can be in the whole plant or in parts thereof such as aboveground (e.g. harvestable) parts, vegetative biomass, roots and/or seeds.

As used herein the phrase "vigor of a plant" or "plant vigor" refers to the amount (e.g., measured by weight) of tissue produced by the plant in a given time. Increased vigor could determine or affect the plant yield or the yield per growing time or growing area. In addition, early vigor (e.g. seed and/or seedling) results in improved field stand.

As used herein the phrase "yield of a plant" or "plant yield" refers to the amount (e.g., as determined by weight or size) or quantity (e.g., numbers) of tissues or organs produced per plant or per growing season. Increased yield of a plant can affect the economic benefit one can obtain from the plant in a certain growing area and/or growing time.

According to an exemplary embodiment the yield is measured by cellulose content.

According to another exemplary embodiment the yield is measured by oil content.

According to another exemplary embodiment the yield is measured by protein content.

A plant yield can be affected by various parameters including, but not limited to, plant biomass; plant vigor; plant growth rate; seed yield; seed or grain quantity; seed or grain quality; oil yield; content of oil, starch and/or protein in harvested organs (e.g., seeds or vegetative parts of the plant); number of flowers (e.g. florets) per panicle (e.g. expressed as a ratio of number of filled seeds over number of primary panicles); harvest index; number of plants grown per area; number and size of harvested organs per plant and per area; number of plants per growing area (e.g. density); number of harvested organs in field; total leaf area; carbon assimilation and carbon partitioning (e.g. the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

A plant yield can be determined under stress (e.g., abiotic stress, as described above) and/or non-stress (e.g. normal) conditions.

The phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

As used herein, the terms "seed" or "grain" refer to a small embryonic plant enclosed in a covering called the seed coat (e.g., usually with some stored food), the product of the ripened ovule of gymnosperm and angiosperm plants which occurs after fertilization and some growth within the mother plant.

As used herein the term "increasing" refers to at least about 2%, at least about 3%, at least about 4%, at least about 5%, at least about 10%, at least about 15%, at least about 20%, at least about 25%, at least about 30%, at least about 35%, at least about 40%, at least about 45%, at least about 50%, at least about 60%, at least about 70%, at least about 80%, at least about 90% or greater increase in tolerance to abiotic stress, in yield, in biomass or in vigor of a plant, as compared to a native or wild-type plants [i.e., plants not modified with the biomolecules (polynucleotides or polypeptides) of the invention, e.g., a non-transformed plant of the same species which is grown under the same growth conditions as the transformed plant].

For example, tolerance to abiotic stress (e.g. tolerance to drought or salinity) can be evaluated by determining the differences in physiological and/or physical condition, including but not limited to, vigor, growth, size, or root length, or specifically, leaf color or leaf area size of the transgenic plant compared to a non-modified plant of the same species grown under the same conditions. Other techniques for evaluating tolerance to abiotic stress include, but are not limited to, measuring chlorophyll fluorescence, photosynthetic rates and gas exchange rates. Further assays for evaluating tolerance to abiotic stress are provided hereinbelow and in the Examples section which follows.

Thus, according to one aspect of the present invention, there is provided a method of increasing tolerance of a plant to an abiotic stress or increasing biomass, vigor or yield of a plant, the method comprising upregulating within the plant an exogenous polynucleotide of a microRNA or a precursor thereof, wherein the microRNA is selected from the group consisting of miR-156, miR-169, miR-164, miR-159, miR-167, miR-529, miR-168, ppt-miR395, sof-miR408a, ath-miR408, miR-1039, miR-1091, miR-1118, miR-1134 and miR-1129, thereby increasing the tolerance of the plant to the abiotic stress or increasing the biomass, vigor or yield of the plant.

According to another aspect of the present invention, there is provided a method of increasing tolerance of a plant to an abiotic stress or increasing biomass, vigor or yield of a plant, the method comprising expressing within the plant an exogenous polynucleotide encoding a nucleic acid agent capable of downregulating expression of a target gene of a microRNA or a precursor thereof, wherein the microRNA is selected from the group consisting of miR-156, miR-169, miR-164, miR-159, miR-167, miR-529, miR-168, ppt-miR395, sof-miR408a, ath-miR408, miR-1039, miR-1091, miR-1118, miR-1134 and miR-1129, thereby increasing the tolerance of the plant to the abiotic stress or increasing the biomass, vigor or yield of the plant.

According to another aspect of the present invention, there is provided a method of increasing tolerance of a plant to an abiotic stress or increasing biomass, vigor or yield of a plant, the method comprising expressing within the plant an exogenous polynucleotide encoding a nucleic acid agent capable of downregulating expression or activity of a microRNA or a precursor thereof, wherein the microRNA is selected from the group consisting of miR-171, miR-172, miR-399, miR-854, miR-894, miR-160, miR-166, miR-390, ath-miR395a, smo-miR408, miR-397, miR-477, miR-528, miR-530, miR-535, miR-855, miR-894, miR-896, miR-901 and miR-1026, thereby increasing the tolerance of the plant to the abiotic stress or increasing the biomass, vigor or yield of the plant.

According to another aspect of the present invention, there is provided a method of increasing tolerance of a plant to an abiotic stress or increasing biomass, vigor or yield of a plant, the method comprising expressing within the plant an exogenous polynucleotide for upregulating expression of a target gene of a microRNA or a precursor thereof, wherein the microRNA is selected from the group consisting of miR-171, miR-172, miR-399, miR-854, miR-894, miR-160, miR-166, miR-390, ath-miR395a, smo-miR408, miR-397, miR-477, miR-528, miR-530, miR-535, miR-855, miR-894, miR-896, miR-901 and miR-1026, thereby increasing the tolerance of the plant to the abiotic stress or increasing the biomass, vigor or yield of the plant.

The method of the present invention is effected by expressing within a plant an exogenous polynucleotide encoding a microRNA or a precursor thereof, a target gene or a down-regulating agent of the target gene or of the miR, as explained below.

As used herein, the phrase "expressing within the plant an exogenous polynucleotide" refers to upregulating the expression level of an exogenous polynucleotide within the plant e.g., by introducing the exogenous polynucleotide into a plant or plant cell and expressing by recombinant means, as described in detail hereinbelow. According to a specific embodiment, short nucleic acid sequences (e.g., miRNAs or precursors thereof) can be introduced into the plant directly as naked RNA and not under a plant promoter. This is especially advantageous when synthetic modifications are introduced (for transient expression such sequences are introduced using any method known in the art such as for example, particle bombardment).

As used herein "expressing" refers to expression at the mRNA level (e.g., in the case of a miRNA or an agent which downregulates expression as described below) or at the polypeptide level (e.g., in the case of a target gene) of the desired exogenous polynucleotide.

As used herein, the phrase "exogenous polynucleotide" refers to a heterologous nucleic acid sequence which may not be naturally expressed within the plant or which overexpression in the plant is desired (i.e., overexpression of an endogenous gene). The exogenous polynucleotide may be introduced into the plant in a stable or transient manner, so as to produce a ribonucleic acid (RNA) molecule and/or a polypeptide molecule. The exogenous polynucleotide may comprise a nucleic acid sequence which is identical or partially homologous to an endogenous nucleic acid sequence expressed within the plant.

The term "endogenous" as used herein refers to any polynucleotide or polypeptide which is present and/or naturally expressed within a plant or a cell thereof.

As used herein the term "polynucleotide" refers to a single or double stranded nucleic acid sequence which is isolated and provided in the form of an RNA sequence, a complementary polynucleotide sequence (cDNA), a genomic polynucleotide sequence to (e.g. sequence isolated from a chromosome) and/or a composite polynucleotide sequences (e.g., a combination of the above). This term includes polynucleotides and/or oligonucleotides derived from naturally occurring nucleic acids molecules (e.g., RNA or DNA), synthetic polynucleotide and/or oligonucleotide molecules composed of naturally occurring bases, sugars, and covalent internucleoside linkages (e.g., backbone), as well as synthetic polynucleotides and/or oligonucleotides having non-naturally occurring portions, which function similarly to the respective naturally occurring portions.

The term "isolated" refers to at least partially separated from the natural environment e.g., from a plant cell.

The polynucleotides of the present invention may be of varying lengths, for example, in case of a nucleic acid sequence encoding a target gene, the length of the polynucleotide may be in the range of about 500 to 2000 nucleic acids. Alternatively, in case of a miRNA or a precursor thereof, the polynucleotide sequence may be of shorter length. For example, in case of a miRNA, the length of the polynucleotide of the present invention is optionally about 100 to 300 nucleotides, about 100 nucleotides or less, about 90 nucleotides or less, about 80 nucleotides or less, about 70 nucleotides or less, about 60 nucleotides or less, about 50 nucleotides or less, about 40 nucleotides or less, about 30 nucleotides or less, e.g., 29 nucleotides, 28 nucleotides, 27 nucleotides, 26 nucleotides, 25 nucleotides, 24 nucleotides, 23 nucleotides, 22 nucleotides, 21 nucleotides, 20 nucleotides, 19 nucleotides, 18 nucleotides, 17 nucleotides, 16 nucleotides, 15 nucleotides, about between 12 and 24 nucleotides, about between 5-15, about, between 5-25, or about 20-22 nucleotides in length.

Nucleic acid sequences of the polypeptides of some embodiments of the invention may be optimized for expression in a specific plant host. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 $SDCU=n=1 \, N[(X_n-Y_n)/Y_n]2/N$, where $X_n$ refers to the frequency of usage of codon n in highly expressed plant genes, where $Y_n$ to the frequency of usage of codon n in the gene of interest and N refers to the total number of codons in the gene of interest. A table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization tables such as those provided on-line at the Codon Usage Database through the NIAS (National Institute of Agrobiological Sciences) DNA bank in Japan (wwwdotkazusadotordotjp/codon/). The Codon Usage Database contains codon usage tables for a number of different species, with each codon usage table having been statistically determined based on the data present in Genbank.

By using the above tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct to full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

As used herein, the phrase "microRNA (also referred to herein interchangeably as "miRNA" or "miR") or a precursor thereof" refers to a microRNA (miRNA) molecule acting as a post-transcriptional regulator. Typically, the miRNA molecules are RNA molecules of about 20 to 22 nucleotides in length which can be loaded into a RISC complex and which direct the cleavage of another RNA molecule, wherein the other RNA molecule comprises a nucleotide sequence essentially complementary to the nucleotide sequence of the miRNA molecule.

Typically, a miRNA molecule is processed from a "pre-miRNA" or as used herein a precursor of a pre-miRNA molecule by proteins, such as DCL proteins, present in any plant cell and loaded onto a RISC complex where it can guide the cleavage of the target RNA molecules.

Pre-microRNA molecules are typically processed from pri-microRNA molecules (primary transcripts). The single stranded RNA segments flanking the pre-microRNA are important for processing of the pri-miRNA into the pre-miRNA. The cleavage site appears to be determined by the distance from the stem-ssRNA junction (Han et al. 2006, Cell 125, 887-901, 887-901).

As used herein, a "pre-miRNA" molecule is an RNA molecule of about 100 to about 200 nucleotides, preferably about 100 to about 130 nucleotides which can adopt a secondary structure comprising a double stranded RNA stem and a single stranded RNA loop (also referred to as "hairpin") and further comprising the nucleotide sequence of the miRNA (and its complement sequence) in the double stranded RNA stem. According to a specific embodiment, the miRNA and its complement are located about 10 to about 20 nucleotides from the free ends of the miRNA double stranded RNA stem. The length and sequence of the single stranded loop region are not critical and may vary considerably, e.g. between 30 and 50 nt in length. The complementarity between the miRNA and its complement need not be perfect and about 1 to 3 bulges of unpaired nucleotides can be tolerated. The secondary structure adopted by an RNA molecule can be predicted by computer algorithms conventional in the art such as mFOLD. The particular strand of the double stranded RNA stem from the pre-miRNA which is released by DCL activity and loaded onto the RISC complex is determined by the degree of complementarity at the 5' end, whereby the strand which at its 5' end is the least involved in hydrogen bounding between the nucleotides of the different strands of the cleaved dsRNA stem is loaded onto the RISC complex and will determine the sequence specificity of the target RNA molecule degradation. However, if empirically the miRNA molecule from a particular synthetic pre-miRNA molecule is not functional (because the "wrong" strand is loaded on the RISC complex), it will be immediately evident that this problem can be solved by exchanging the position of the miRNA molecule and its complement on the respective strands of the dsRNA stem of the pre-miRNA molecule. As is known in the art, binding between A and U involving two hydrogen bounds, or G and U involving two hydrogen bounds is less strong that between G and C involving three hydrogen bounds. Exemplary hairpin sequences are provided in Table 1, below.

According to the present teachings, the miRNA molecules may be naturally occurring or synthetic.

Naturally occurring miRNA molecules may be comprised within their naturally occurring pre-miRNA molecules but they can also be introduced into existing pre-miRNA molecule scaffolds by exchanging the nucleotide sequence of the miRNA molecule normally processed from such existing pre-miRNA molecule for the nucleotide sequence of another miRNA of interest. The scaffold of the pre-miRNA can also be completely synthetic. Likewise, synthetic miRNA molecules may be comprised within, and processed from, existing pre-miRNA molecule scaffolds or synthetic pre-miRNA scaffolds. Some pre-miRNA scaffolds may be preferred over others for their efficiency to be correctly processed into the designed microRNAs, particularly when expressed as a chimeric gene wherein other DNA regions, such as untranslated leader sequences or transcription termination and polyadenylation regions are incorporated in the primary transcript in addition to the pre-microRNA. One of ordinary skill in the art can decide on the proper pre-miRNA scaffold to use for generation of the miRNA molecules of the present invention while taking into account the presence of additional sequences which may influence the folding of the primary transcript RNA molecule into a secondary RNA structure and particularly on presence and location of bulges or single stranded RNA structures in otherwise doublestranded RNA stem (sub)structures. The location of single-stranded RNA or bulge structures relative to the pre-miRNA, i.e. the distance in nucleotides should be carefully maintained. Secondary RNA structures for a particular RNA nucleotide sequence can easily be predicted using software tools and algorithms well known in the art such as mFOLD (Zucker et al. 2003 Nucleic Acids Research 31, 3406-3415). Furthermore, it is well within the skill of one of ordinary skill in the art to design or modify a nucleotide by substituting nucleotides in a nucleotide sequence such that the newly introduced nucleotides exhibit more or less complementarity to another part of the nucleotide sequence and in this way influence the generation of double-stranded RNA stems or of single stranded RNA bulges.

Thus, as mentioned the present invention envisages increasing tolerance of a plant to an abiotic stress or increasing biomass, vigor or yield of a plant by upregulating (e.g., expressing), within the plant a polynucleotide of a microRNA selected from the group consisting of miR-156 (e.g. bna-miR156a, smo-miR156c, sbi-miR156d, smo-miR156d, vvi-miR156e, ath-miR156g, ptc-miR156k, zma-miR156k and osa-miR1561), miR-169 (e.g. ath-miR169a, osa-miR169a, sbi-miR169b, bna-miR169c, sbi-miR169c, ath-miR169d, osa-miR169e, bna-miR169g, sbi-miR169i, bna-miR169m, vvi-miR169m, ptc-miR169o, ptc-miR169q, ptc-miR169v and ptc-miR169x), miR-164 (e.g. osa-miR164a, sbi-miR164b, osa-miR164c, osa-miR164e and ptc-miR164f), miR-159 (e.g. pta-miR159c, sof-miR159c, osa-miR159c and osa-miR159d), miR-167 (e.g. ppt-miR167, bna-miR167a, ath-miR167c, ath-miR167d, ptc-miR167f and ptc-miR167h), to miR-529 (e.g. ppt-miR529a, ppt-miR529d, ppt-miR529e and ppt-miR529g), miR-168 (e.g.

sbi-miR168 and gma-miR168), ppt-miR395, sof-miR408a, ath-miR408, miR-1039 (e.g. ppt-miR1039-3p), miR-1091 (e.g. smo-miR1091), miR-1118 (e.g. tae-miR1118), miR-1134 (e.g. tae-miR1134) and miR-1129 (e.g. tae-miR1129). For the complete list of miRNAs contemplated by the present teachings, hairpins thereof and their corresponding sequences see Table 1, below.

TABLE 1

Sequence identification of miRNAs and their corresponding hairpins

| MicroRNA | miR SEQ ID NO. | hairpins SEQ ID NO. |
|---|---|---|
| osa-miR169e | 1 | 11 |
| ath-miR169a | 2 | 12, 194 |
| ptc-miR169o | 3 | 13 |
| bna-miR169c | 4 | 14 |
| ptc-miR169v | 5 | 15 |
| ath-miR169d | 6 | 16 |
| ath-miR167c | 7 | 17 |
| bna-miR167a | 8 | 18 |
| ppt-miR167 | 9 | 19 |
| ptc-miR167f | 10 | 20 |
| ppt-miR894 | 21 | 26 |
| osa-miR164e | 22 | 27 |
| bna-miR169g | 23 | 28 |
| vvi-miR169m | 24 | 29 |
| ptc-miR169q | 25 | 30 |
| bna-miR156a | 31 | 49 |
| ath-miR156g | 32 | 50 |
| osa-miR1561 | 33 | 51 |
| ath-miR854a | 34 | 52 |
| ppt-miR1039-3p | 35 | 53 |
| zma-miR156k | 36 | 54 |
| vvi-miR156e | 37 | 55 |
| sbi-miR156d | 38 | 56 |
| ath-miR167d | 39 | 57 |
| ptc-miR167h | 40 | 58 |
| sbi-miR168 | 41 | 59 |
| gma-miR168 | 42 | 60 |
| sof-miR408a | 43 | 61 |
| ath-miR408 | 44 | 62 |
| ppt-miR160b | 45 | 63 |
| ppt-miR160c | 46 | 64 |
| osa-miR390 | 47 | 65 |
| ppt-miR390c | 48 | 66 |
| sbi-miR172e | 73 | 67 |
| smo-miR171a | 74 | 68 |
| smo-miR171b | 75 | 69 |
| sbi-miR171b | 76 | 70 |
| zma-miR171c | 77 | 71 |
| zma-miR171f | 78 | 72 |
| smo-miR156c | 79 | 137 |
| smo-miR156d | 80 | 138 |
| ppt-miR395 | 81 | 139 |
| smo-miR1091 | 82 | 140 |
| tae-miR1118 | 83 | 141 |
| tae-miR1134 | 84 | 142 |
| vvi-miR171a | 85 | 143 |
| vvi-miR171i | 86 | 144 |
| gma-miR172a | 87 | 145 |
| ath-miR172c | 88 | 146 |
| zma-miR172e | 89 | 147 |
| sbi-miR399b | 90 | 148 |
| osa-miR530-3p | 91 | 149 |
| ppt-miR529a | 92 | 150 |
| ppt-miR529d | 93 | 151 |
| ppt-miR529e | 94 | 152 |
| ppt-miR529g | 95 | 153 |
| osa-miR169a | 96 | 154 |
| sbi-miR169b | 97 | 155 |
| bna-miR169m | 98 | 156 |
| ath-miR395a | 99 | 157 |
| bna-miR397a | 100 | 158 |
| ptc-miR397b | 101 | 159 |
| smo-miR408 | 102 | 160 |
| osa-miR528 | 103 | 161 |

TABLE 1-continued

Sequence identification of miRNAs and their corresponding hairpins

| MicroRNA | miR SEQ ID NO. | hairpins SEQ ID NO. |
|---|---|---|
| ath-miR171b | 104 | 162 |
| ppt-miR896 | 105 | 163 |
| pta-miR159c | 106 | 164 |
| sof-miR159c | 107 | 165 |
| osa-miR159c | 108 | 166 |
| osa-miR159d | 109 | 167 |
| osa-miR164a | 110 | 168 |
| sbi-miR164b | 111 | 169 |
| osa-miR164c | 112 | 170 |
| ptc-miR164f | 113 | 171 |
| tae-miR1129 | 114 | 172 |
| sof-miR168b | 115 | 173 |
| osa-miR168b | 116 | 174 |
| sbi-miR169c | 117 | 175 |
| sbi-miR169i | 118 | 176 |
| ptc-miR169x | 119 | 177 |
| sbi-miR171e | 120 | 178 |
| sbi-miR171f | 121 | 179 |
| mtr-miR399d | 122 | 180 |
| ppt-miR477a-3p | 123 | 181 |
| ath-miR855 | 124 | 182 |
| ppt-miR1026a | 125 | 183 |
| ppt-miR901 | 126 | 184 |
| sbi-miR166e | 127 | 185 |
| sbi-miR399a | 128 | 186 |
| ptc-miR156k | 129 | 187 |
| osa-miR529b | 130 | 188 |
| vvi-miR535a | 131 | 189 |
| ptc-miR169t | 132 | 190 |
| ath-miR156a | 133 | 191 |
| ath-miR164a | 134 | 192 |
| ath-miR167a | 135 | 193 |

The present invention envisages the use of homologous sequences of the above miRNAs. Thus, used are also nucleic acid sequences which are at least about 60%, at least about 65%, at least about 70%, at least about 75%, at least about 80%, at least about 85%, at least about 90%, at least about 95% or more identical or similar to SEQ ID NOs: 1-193. Parameters for determining the level of identity are provided hereinbelow.

The miRNA molecules (or pre-miRNA processed into miRNA molecules) of the present teachings may alter the level of expression of the target genes (e.g. upregulate or to downregulate) and consequently increase tolerance of plants to severe stress (e.g. abiotic stress conditions) or increase biomass, vigor or yield of the plant. Thus, the microRNAs of the present teachings may bind, attach, regulate, process, interfere, and/or destabilize any microRNA target. Such a target can be any molecule, including, but not limited to, DNA molecules, RNA molecules and polypeptides.

As used herein a "target gene" refers to a gene that is processed by microRNA activity. Typically the gene encodes a polypeptide which expression is down-regulated due to microRNA processing, however, the present invention also envisages target genes which have mRNA expression products but not polypeptide products.

Thus as mentioned hereinabove, increasing tolerance of a plant to an abiotic stress or increasing biomass, vigor or yield of a plant, is effected by expressing within the plant an exogenous polynucleotide encoding a nucleic acid agent capable of downregulating expression of a target gene of a microRNA or a precursor thereof, wherein the microRNA is selected from the group consisting of miR-156, miR-169, miR-164, miR-159, miR-167, miR-529, miR-168, ppt-miR395, sof-miR408a, ath-miR408, miR-1039, miR-1091, miR-1118, miR-1134 and miR-1129, thereby increasing the tolerance of the plant to the abiotic stress or increasing the biomass, vigor or yield of the plant.

Target genes which are contemplated according to the present teachings are provided in the polynucleotide sequences which comprise nucleic acid sequences as set forth in SEQ ID NO: 195-341 and 474-485. However the present teachings also relate to orthologs or homologs at least about 60%, at least about 65%, at least about 70%, at least about 75%, at least about 80%, at least about 85%, at least about 90%, or at least about 95% or more identical or similar to SEQ ID NO: 195-341 and 474-485. Parameters for determining the level of identity are provided hereinbelow Alternatively or additionally, target genes which are contemplated according to the present teachings are provided in the polypeptide sequences which comprise amino acid sequences as set forth in SEQ ID NO: 342-473 and 486-496. However the present teachings also relate to of orthologs or homologs at least about 60%, at least about 65%, at least about 70%, at least about 75%, at least about 80%, at least about 85%, at least about 90%, or at least about 95% or more identical or similar to SEQ ID NO: 342-473 and 486-496. Parameters for determining the level of identity are provided hereinbelow Examples of polynucleotide and polypeptide downregulating agents that inhibit (also referred to herein as inhibitors) the expression of a target gene are given below.

1. Polynucleotide-Based Inhibition of Gene Expression.

It will be appreciated, that any of these methods when specifically referring to downregulating expression/activity of the target genes can be used, at least in part, to downregulate expression or activity of endogenous miRNA molecules.

i. Sense Suppression/Cosuppression

In some embodiments of the invention, inhibition of the expression of target gene may be obtained by sense suppression or cosuppression. For cosuppression, an expression cassette is designed to express an RNA molecule corresponding to all or part of a messenger RNA encoding a target gene in the "sense" orientation. Over-expression of the RNA molecule can result in reduced expression of the native gene. Accordingly, multiple plant lines transformed with the cosuppression expression cassette are screened to identify those that show the greatest inhibition of target gene expression.

The polynucleotide used for cosuppression may correspond to all or part of the sequence encoding the target gene, all or part of the 5' and/or 3' untranslated region of a target transcript, or all or part of both the coding sequence and the untranslated regions of a transcript encoding the target gene. In some embodiments where the polynucleotide comprises all or part of the coding region for the target gene, the expression cassette is designed to eliminate the start codon of the polynucleotide so that no protein product will be transcribed.

Cosuppression may be used to inhibit the expression of plant genes to produce plants having undetectable protein levels for the proteins encoded by these genes. See, for example, Broin, et al., (2002) Plant Cell 15:1517-1532. Cosuppression may also be used to inhibit the expression of multiple proteins in the same plant. Methods for using cosuppression to inhibit the expression of endogenous genes in plants are described in Flavell, et al., (1995) Proc. Natl. Acad. Sci. USA 91:3590-3596; Jorgensen, et al., (1996) Plant Mol. Biol. 31:957-973; Johansen and Carrington, (2001) Plant Physiol. 126:930-938; Broin, et al., (2002) Plant Cell 15:1517-1532; Stoutjesdijk, et al., (2002) Plant Physiol. 129:1723-1731; Yu, et al., (2003) Phytochemistry 63:753-763; and U.S. Pat. Nos. 5,035,323, 5,283,185 and 5,952,657; each of which is herein incorporated by reference. The efficiency of cosuppression may be increased by including a poly-dt region in the expression cassette at a position 3' to the sense sequence and 5' of the polyadenylation signal. See, US Patent Publication Number 20020058815, herein incorporated by reference. Typically, such a nucleotide sequence has substantial sequence identity to the sequence of the transcript of the endogenous gene, optimally greater than about 65% sequence identity, more optimally greater than about 85% sequence identity, most optimally greater than about 95% sequence identity. See, U.S. Pat. Nos. 5,283,185 and 5,035,323; herein incorporated by reference.

Transcriptional gene silencing (TGS) may be accomplished through use of hpRNA constructs wherein the inverted repeat of the hairpin shares sequence identity with the promoter region of a gene to be silenced. Processing of the hpRNA into short RNAs which can interact with the homologous promoter region may trigger degradation or methylation to result in silencing. (Aufsatz, et al., (2002) PNAS 99(4):16499-16506; Mette, et al., (2000) EMBO J. 19(19):5194-5201)

ii. Antisense Suppression

In some embodiments of the invention, inhibition of the expression of the target gene may be obtained by antisense suppression. For antisense suppression, the to expression cassette is designed to express an RNA molecule complementary to all or part of a messenger RNA encoding the target gene. Over-expression of the antisense RNA molecule can result in reduced expression of the native gene. Accordingly, multiple plant lines transformed with the antisense suppression expression cassette are screened to identify those that show the greatest inhibition of target gene expression.

The polynucleotide for use in antisense suppression may correspond to all or part of the complement of the sequence encoding the target gene, all or part of the complement of the 5' and/or 3' untranslated region of the target gene transcript, or all or part of the complement of both the coding sequence and the untranslated regions of a transcript encoding the target gene. In addition, the antisense polynucleotide may be fully complementary (i.e., 100% identical to the complement of the target sequence) or partially complementary (i.e., less than 100% identical to the complement of the target sequence) to the target sequence. Antisense suppression may be used to inhibit the expression of multiple proteins in the same plant. Furthermore, portions of the antisense nucleotides may be used to disrupt the expression of the target gene. Generally, sequences of at least 50 nucleotides, 100 nucleotides, 200 nucleotides, 300, 500, 550, 500, 550 or greater may be used. Methods for using antisense suppression to inhibit the expression of endogenous genes in plants are described, for example, in Liu, et al., (2002) Plant Physiol. 129:1732-1753 and U.S. Pat. No. 5,759,829, which is herein incorporated by reference. Efficiency of antisense suppression may be increased by including a poly-dt region in the expression cassette at a position 3' to the antisense sequence and 5' of the polyadenylation signal. See, US Patent Publication Number 20020058815.

iii. Double-Stranded RNA Interference

In some embodiments of the invention, inhibition of the expression of a target gene may be obtained by double-stranded RNA (dsRNA) interference. For dsRNA interference, a sense RNA molecule like that described above for cosuppression and an antisense RNA molecule that is fully or partially complementary to the sense RNA molecule are expressed in the same cell, resulting in inhibition of the expression of the corresponding endogenous messenger RNA.

Expression of the sense and antisense molecules can be accomplished by designing the expression cassette to comprise both a sense sequence and an antisense to sequence. Alternatively, separate expression cassettes may be used for the sense and antisense sequences. Multiple plant lines transformed with the dsRNA interference expression cassette or expression cassettes are then screened to identify plant lines that show the greatest inhibition of target gene expression. Methods for using dsRNA interference to inhibit the expression of endogenous plant genes are described in Waterhouse, et al., (1998) Proc. Natl. Acad. Sci. USA 95:13959-13965, Liu, et al., (2002) Plant Physiol. 129:1732-1753, and WO 99/59029, WO 99/53050, WO 99/61631, and WO 00/59035;

iv. Hairpin RNA Interference and Intron-Containing Hairpin RNA Interference

In some embodiments of the invention, inhibition of the expression of one or more target gene may be obtained by hairpin RNA (hpRNA) interference or intron-containing hairpin RNA (ihpRNA) interference. These methods are highly efficient at downregulating the expression of endogenous genes. See, Waterhouse and Helliwell, (2003) Nat. Rev. Genet. 5:29-38 and the references cited therein.

For hpRNA interference, the expression cassette is designed to express an RNA molecule that hybridizes with itself to form a hairpin structure that comprises a single-stranded loop region and a base-paired stem. The base-paired stem region comprises a sense sequence corresponding to all or part of the endogenous messenger RNA encoding the gene whose expression is to be inhibited, and an antisense sequence that is fully or partially complementary to the sense sequence. Thus, the base-paired stem region of the molecule generally determines the specificity of the RNA interference. hpRNA molecules are highly efficient at inhibiting the expression of endogenous genes, and the RNA interference they induce is inherited by subsequent generations of plants. See, for example, Chuang and Meyerowitz, (2000) Proc. Natl. Acad. Sci. USA 97:5985-5990; Stoutjesdijk, et al., (2002) Plant Physiol. 129:1723-1731; and Waterhouse and Helliwell, (2003) Nat. Rev. Genet. 5:29-38. Methods for using hpRNA interference to inhibit or silence the expression of genes are described, for example, in Chuang and Meyerowitz, (2000) Proc. Natl. Acad. Sci. USA 97:5985-5990; Stoutjesdijk, et al., (2002) Plant Physiol. 129:1723-1731; Waterhouse and Helliwell, (2003) Nat. Rev. Genet. 5:29-38; Pandolfini, et al., BMC Biotechnology 3:7, and US Patent Publication Number 20030175965; each of which is herein incorporated by reference. A transient assay for the efficiency of hpRNA constructs to silence gene expression in vivo has to been described by Panstruga, et al., (2003) Mol. Biol. Rep. 30:135-150, herein incorporated by reference.

For ihpRNA, the interfering molecules have the same general structure as for hpRNA, but the RNA molecule additionally comprises an intron that is capable of being spliced in the cell in which the ihpRNA is expressed. The use of an intron minimizes the size of the loop in the hairpin RNA molecule following splicing, and this increases the efficiency of interference. See, for example, Smith, et al., (2000) Nature 507:319-320. In fact, Smith, et al., show 100% suppression of endogenous gene expression using ihpRNA-mediated interference. Methods for using ihpRNA interference to inhibit the expression of endogenous plant genes are described, for example, in Smith, et al., (2000) Nature 507:319-320; Wesley, et al., (2001) Plant J. 27:581-590; Wang and Waterhouse, (2001) Curr. Opin. Plant Biol. 5:156-150; Waterhouse and Helliwell, (2003) Nat. Rev. Genet. 5:29-38; Helliwell and Waterhouse, (2003) Methods 30:289-295, and US Patent Publication Number 20030180955, each of which is herein incorporated by reference.

The expression cassette for hpRNA interference may also be designed such that the sense sequence and the antisense sequence do not correspond to an endogenous RNA. In this embodiment, the sense and antisense sequence flank a loop sequence that comprises a nucleotide sequence corresponding to all or part of the endogenous messenger RNA of the target gene. Thus, it is the loop region that determines the specificity of the RNA interference. See, for example, WO 02/00905, herein incorporated by reference.

v. Amplicon-Mediated Interference

Amplicon expression cassettes comprise a plant virus-derived sequence that contains all or part of the target gene but generally not all of the genes of the native virus. The viral sequences present in the transcription product of the expression cassette allow the transcription product to direct its own replication. The transcripts produced by the amplicon may be either sense or antisense relative to the target sequence (i.e., the messenger RNA for target gene). Methods of using amplicons to inhibit the expression of endogenous plant genes are described, for example, in Angell and Baulcombe, (1997) EMBO J. 16:3675-3685, Angell and Baulcombe, (1999) Plant J. 20:357-362, and U.S. Pat. No. 6,656,805, each of which is herein incorporated by reference.

vi. Ribozymes

In some embodiments, the polynucleotide expressed by the expression cassette of the invention is catalytic RNA or has ribozyme activity specific for the messenger RNA of target gene. Thus, the polynucleotide causes the degradation of the endogenous messenger RNA, resulting in reduced expression of the target gene. This method is described, for example, in U.S. Pat. No. 5,987,071, herein incorporated by reference.

2. Polypeptide-Based Inhibition of Gene Expression

In one embodiment, the polynucleotide encodes a zinc finger protein that binds to a gene encoding a target polypeptide, resulting in downregulated expression of the gene. In particular embodiments, the zinc finger protein binds to a regulatory region of a miRNA or a target polypeptide. In other embodiments, the zinc finger protein binds to a messenger RNA encoding a miRNA or a target polypeptide and prevents its translation. Methods of selecting sites for targeting by zinc finger proteins have been described, for example, in U.S. Pat. No. 6,553,252, and methods for using zinc finger proteins to inhibit the expression of genes in plants are described, for example, in US Patent Publication Number 20030037355; each of which is herein incorporated by reference.

3. Polypeptide-Based Inhibition of Protein Activity

In some embodiments of the invention, the polynucleotide encodes an antibody that binds to at least one target polypeptide, and downregulates the response regulator activity of the target polypeptide. In another embodiment, the binding of the antibody results in increased turnover of the antibody-target polypeptide complex by cellular quality control mechanisms. The expression of antibodies in plant cells and the inhibition of molecular pathways by expression and binding of antibodies to proteins in plant cells are well

4. Gene Disruption

In some embodiments of the present invention, the activity of a miRNA or a target gene is reduced or eliminated by disrupting the gene encoding the target polypeptide. The gene encoding the target polypeptide may be disrupted by any method known in the art. For example, in one embodiment, the gene is disrupted by transposon tagging. In another embodiment, the gene is disrupted by mutagenizing plants using random or targeted mutagenesis, and selecting for plants that have reduced response regulator activity.

As mentioned, the present inventor has uncovered that increasing tolerance of a plant to an abiotic stress or increasing biomass, vigor or yield of a plant can be achieved by downregulating the activity or expression of a miRNA selected from the group consisting of miR-171 (e.g. smo-miR171a, vvi-miR171a, ath-miR171b, sbi-miR171b, smo-miR171b, zma-miR171c, sbi-miR171e, sbi-miR171f, zma-miR171f and vvi-miR171i), miR-172 (e.g. gma-miR172a, ath-miR172c and zma-miR172e), miR-399 (e.g. sbi-miR399a, sbi-miR399b and mtr-miR399d), miR-854 (e.g. ath-miR854a), miR-894, miR-160 (e.g. ppt-miR160b and ppt-miR160c), miR-166 (e.g. sbi-miR166e), miR-390 (e.g. osa-miR390 and ppt-miR390c), ath-miR395a, smo-miR408, miR-397 (e.g. bna-miR397a and ptc-miR397b), miR-477 (e.g. ppt-miR477a—3p), miR-528 (e.g. osa-miR528), miR-530 (e.g. osa-miR530-3p), miR-535 (e.g. vvi-miR535a), miR-855 (e.g. ath-miR855), miR-894 (e.g. ppt-miR894), miR-896 (e.g. ppt-miR896), miR-901 (e.g. ppt-miR901) and miR-1026 (e.g. ppt-miR1026a For the complete list of miRNAs contemplated by the present teachings, pre-miRNAs thereof and their corresponding sequences see Table 1, above.

Rendering miRNA molecules less functional or non-functional may be achieved in several ways as discussed in detail above.

Alternatively, downregulating the activity of miRNA molecules can be effected by upregulating the expression of the target gene RNA (or at least the part thereof recognized by the miRNA). Such an increase in target gene RNA may be conveniently achieved by introducing into the plant cells a nucleic acid sequence encoding a polypeptide being at least about 60%, at least about 65%, at least about 70%, at least about 75%, at least about 80%, at least about 85%, at least about 90%, or at least about 95% or more similar or identical to SEQ ID NO: 342-473 and 486-496 under the regulation of a plant promoter.

Alternatively, such an increase in target gene RNA may be achieved by introducing into the plant cells a nucleic acid sequence at least about 60%, at least about 65%, at least about 70%, at least about 75%, at least about 80%, at least about 85%, at least about 90%, or at least about 95% or more similar or identical to SEQ ID NOs: 195-341 and 474-485 under the regulation of a plant promoter.

Identity (e.g., percent identity) can be determined using any homology comparison software, including for example, the Basic Local Alignment Search Tool BlastN® (National Library of Medicine) software of the National Center of Biotechnology Information (NCBI) such as by using default parameters.

Homology (e.g., percent homology) can be determined using any homology comparison software, including for example, the BlastP® (National Library of Medicine) or TBLASTN® (National Library of Medicine) software of the National Center of Biotechnology Information (NCBI) such as by using default parameters, when starting from a polypeptide sequence; or the tBLASTX®(National Library of Medicine) algorithm (available via the NCBI) such as by using default parameters, which compares the six-frame conceptual translation products of a nucleotide query sequence (both strands) against a protein sequence database. Homologous sequences include both orthologous and paralogous sequences.

Exemplary target genes of miRNAs which may be expressed in plant cells include, but are not limited to, the target gene of miR-171, the target gene of miR-172, the target gene of miR-399, the target gene of miR-854, the target gene of miR-894, the target gene of miR-160, the target gene of miR-166, the target gene of miR-390, the target gene of ath-miR395a, the target gene of smo-miR408, the target gene of miR-397, the target gene of miR-477, the target gene of miR-528, the target gene of miR-530, the target gene of miR-535, the target gene of miR-855, the target gene of miR-894, the target gene of miR-896, the target gene of miR-901 and the target gene of miR-1026 (SEQ ID NOs: 195-496).

According to another embodiment of the present invention, downregulating the activity of a miRNA is effected by introducing into the plant a target mimic or a micro-RNA resistant target which is bound by the miRNA but is not cleaved by the microRNA.

According to a specific embodiment, the target mimic or micro-RNA resistant target may also be linked to the promoter naturally associated with the pre-miRNA recognizing the target gene and introduced into the plant cell. In this way, the miRNA target mimic or micro-RNA resistant target RNA will be expressed under the same circumstances as the miRNA and the target mimic or micro-RNA resistant target RNA will substitute for the non-target mimic/micro-RNA resistant target RNA degraded by the miRNA induced cleavage.

Thus, the target mimic or micro-RNA resistant target is essentially complementary to the microRNA provided that one or more of following mismatches are allowed:

(a) a mismatch between the nucleotide at the 5' end of the microRNA and the corresponding nucleotide sequence in the target mimic or micro-RNA resistant target;

(b) a mismatch between any one of the nucleotides in position 1 to position 9 of the microRNA and the corresponding nucleotide sequence in the target mimic or micro-RNA resistant target; or (c) three mismatches between any one of the nucleotides in position 12 to position 21 of the microRNA and the corresponding nucleotide sequence in the target mimic or micro-RNA resistant target provided that there are no more than two consecutive mismatches.

The target mimic RNA is essentially similar to the target RNA modified to render it resistant to miRNA induced cleavage, e.g. by modifying the sequence thereof such that a variation is introduced in the nucleotide of the target sequence complementary to the nucleotides 10 or 11 of the miRNA resulting in a mismatch. Clearly if the target RNA is a RNA coding for a protein any modification would need to be silent with regard to the coding region or at least result in a substitution yielding a functional protein.

Alternatively, a microRNA-resistant target may be implemented. Thus, a silent mutation may be introduced in the microRNA binding site of the target gene so that the DNA and resulting RNA sequences are changed in a way that prevents microRNA binding, but the amino acid sequence of the protein is unchanged. Thus, a new sequence can be synthesized instead of the existing binding site, in which the DNA sequence is changed, but the translated amino acid sequence is retained resulted in lack of miRNA binding to its target.

Non-functional miRNA alleles or miRNA resistant target genes may also be introduced by homologous recombination to substitute the miRNA encoding alleles or miRNA sensitive target genes.

Recombinant expression is effected by cloning the nucleic acid of interest (e.g., miRNA, target gene, silencing agent etc) into a nucleic acid expression construct under the expression of a plant promoter.

According to some embodiments of the invention, there is provided a nucleic to acid construct, comprising a polynucleotide at least about 80%, at least about 85%, at least about 90%, at least about 95% or more homologous to a nucleic acid sequence selected from the group consisting of miR-156, miR-169, miR-164, miR-159, miR-167, miR-529, miR-168, ppt-miR395, sof-miR408a, ath-miR408, miR-1039, miR-1091, miR-1118, miR-1134 and miR-1129 or a precursor thereof, wherein the nucleic acid sequence is under a transcriptional control of at least one promoter capable of directing transcription of the polynucleotide in a host cell.

It will be appreciated that the pre-miRNA molecules or miRNA molecules of the present invention can be introduced into a plant by providing a cell of the plant with a polynucleotide sequence comprising a plant-expressible promoter operably linked to a DNA region, which when transcribed yields the pre-miRNA or miRNA molecule (explained further below). The plant expressible promoter may be the promoter naturally associated with the pre-miRNA molecule or it may be a heterologous promoter.

According to some embodiments of the invention, there is provided a nucleic acid construct, comprising a polynucleotide at least about 80%, at least about 85%, at least about 90%, at least about 95% or more homologous to a nucleic acid sequence selected from the group consisting of a target gene of miR-171, a target gene of miR-172, a target gene of miR-399, a target gene of miR-854, a target gene of miR-894, a target gene of miR-160, a target gene of miR-166, a target gene of miR-390, a target gene of ath-miR395a, a target gene of smo-miR408, a target gene of miR-397, a target gene of miR-477, a target gene of miR-528, a target gene of miR-530, a target gene of miR-535, a target gene of miR-855, a target gene of miR-894, a target gene of miR-896, a target gene of miR-901 and a target gene of miR-1026, wherein the nucleic acid sequence is under a transcriptional control of at least one promoter capable of directing transcription of the polynucleotide in a host cell.

According to some embodiments of the invention, there is provided a nucleic acid construct, comprising a nucleic acid sequence for down-regulating an expression of a target gene of a microRNA or a precursor thereof, wherein the target gene of the microRNA is selected from the group consisting of a target gene of miR-156, a target gene of miR-169, a target gene of miR-164, a target gene of miR-159, a target gene of miR-167, a target gene of miR-529, a target gene of miR-168, a target gene of ppt-miR395, a target gene of sof-miR408a, a target gene of ath-miR408, a target gene of miR-1039, a target gene of miR-1091, a target gene of miR-1118, a target gene of miR-1134 and a target gene of miR-1129, wherein the nucleic acid sequence is under a transcriptional control of at least one promoter capable of directing transcription of the polynucleotide in a host cell.

According to a specific example of the present teachings, the target gene of miR-169 is a NF-YA8 protein.

According to some embodiments of the invention, there is provided a nucleic acid construct, comprising a nucleic acid sequence for down-regulating an expression of a microRNA or a precursor thereof, wherein the microRNA is selected from the group consisting of miR-171, miR-172, miR-399, miR-854, miR-894, miR-160, miR-166, miR-390, ath-miR395a, smo-miR408, miR-397, miR-477, miR-528, miR-530, miR-535, miR-855, miR-894, miR-896, miR-901 and miR-1026, wherein the nucleic acid sequence is under a transcriptional control of at least one promoter capable of directing transcription of the polynucleotide in a host cell.

According to a specific embodiment, the host cell comprises a plant cell.

Expressing the exogenous polynucleotides of the present invention (e.g. miRNA molecules, targets thereof, mimic sequences, downregulating agents) may be effected by transforming a cell of a plant with the exogenous polynucleotide.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores.

As used herein the phrase "plant cell" refers to plant cells which are derived and isolated from disintegrated plant cell tissue or plant cell cultures.

As used herein the phrase "plant cell culture" refers to any type of native (naturally occurring) plant cells, plant cell lines and genetically modified plant cells, which are not assembled to form a complete plant, such that at least one biological structure of a plant is not present. Optionally, the plant cell culture of this aspect of the present invention may comprise a particular type of a plant cell or a plurality of to different types of plant cells. It should be noted that optionally plant cultures featuring a particular type of plant cell may be originally derived from a plurality of different types of such plant cells.

Any commercially or scientifically valuable plant is envisaged in accordance with these embodiments of the invention. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis*, *Albizia amara*, *Alsophila tricolor*, *Andropogon* spp., *Arachis* spp, *Areca catechu*, *Astelia fragrans*, *Astragalus cicer*, *Baikiaea plurijuga*, *Betula* spp., *Brassica* spp., *Bruguiera gymnorrhiza*, *Burkea africana*, *Butea frondosa*, *Cadaba farinosa*, *Calliandra* spp, *Camellia sinensis*, *Canna indica*, *Capsicum* spp., *Cassia* spp., *Centroema pubescens*, *Chacoomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cydonia oblonga*, *Cryptomeria japonica*, *Cymbopogon* spp., *Cynthea dealbata*, *Cydonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalyptus* spp., *Euclea schimperi*, *Eulalia* vi/losa, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia*

*altissima, Heteropogon contoffus, Hordeum vulgare, Hyparrhenia rufa, Hypericum erectum, Hypeffhelia dissolute, Indigo incamata, Iris* spp., *Leptarrhena pyrolifolia, Lespediza* spp., *Lettuca* spp., *Leucaena leucocephala, Loudetia simplex, Lotonus bainesli, Lotus* spp., *Macrotyloma axillare, Malus* spp., *Manihot esculenta, Medicago saliva, Metasequoia glyptostroboides, Musa sapientum, Nicotianum* spp., *Onobrychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativam, Podocarpus totara, Pogonarthria fleckii, Pogonaffhria squarrosa, Populus* spp., *Prosopis cineraria,* to *Pseudotsuga menziesii, Pterolobium stellatum, Pyrus communis, Quercus* spp., *Rhaphiolepsis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys vefficillata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp, *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays,* amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barely, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant including, but not limited to, cotton, *Brassica* vegetables, oilseed rape, sesame, olive tree, palm oil, banana, wheat, corn or maize, barley, alfalfa, peanuts, sunflowers, rice, oats, sugarcane, soybean, turf grasses, barley, rye, *sorghum,* sugar cane, chicory, lettuce, tomato, zucchini, bell pepper, eggplant, cucumber, melon, watermelon, beans, hibiscus, okra, apple, rose, strawberry, chile, garlic, pea, lentil, canola, mums, *arabidopsis,* broccoli, cabbage, beet, quinoa, spinach, squash, onion, leek, tobacco, potato, sugarbeet, papaya, pineapple, mango, *Arabidopsis thaliana,* and also plants used in horticulture, floriculture or forestry, such as, but not limited to, poplar, fir, eucalyptus, pine, an ornamental plant, a perennial grass and a forage crop, coniferous plants, moss, algae, as well as other plants listed in World Wide Web (dot) nationmaster (dot) com/encyclopedia/Plantae.

According to a specific embodiment of the present invention, the plant comprises corn.

According to a specific embodiment of the present invention, the plant comprises *sorghum.*

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter capable of directing transcription of the exogenous polynucleotide in the plant cell. Further details of suitable transformation approaches are provided herein below.

Exemplary nucleic acid constructs which have been constructed and used for plant transformation by the present inventor include pORE156, pORE164, pORE167 and pORE169, which were all constructed by ligating the appropriate DNA fragments into the pORE E2 binary vector (Accession number: AY562535) under the transcriptional control of a promoter. The following nucleic acid sequences where used, respectively, therein: ath-miR156a (SEQ ID NO: 191), ath-miR164a (SEQ ID NO: 192), ath-miR167a (SEQ ID NO: 193), and ath-miR169a (SEQ ID NO: 12), as described in detail in Example 5 of the Examples section which follows.

A coding nucleic acid sequence is "operably linked" to a regulatory sequence (e.g., promoter) if the regulatory sequence is capable of exerting a regulatory effect on the coding sequence linked thereto.

As used herein, the term "promoter" denotes any DNA which is recognized and bound (directly or indirectly) by a DNA-dependent RNA-polymerase during initiation of transcription. The promoter controls where (e.g., which portion of a plant) and/or when (e.g., at which stage or condition in the lifetime of an organism) the gene is expressed. Thus, a promoter includes the transcription initiation site, and binding sites for transcription initiation factors and RNA polymerase, and can comprise various other to sites (e.g., enhancers), at which gene expression regulatory proteins may bind.

The term "regulatory sequence", as used herein, means any DNA, that is involved in driving transcription and controlling (i.e., regulating) the timing and level of transcription of a given DNA sequence, such as a DNA coding for a protein or polypeptide. For example, a 5' regulatory region (or "promoter region") is a DNA sequence located upstream (i.e., 5') of a coding sequence and which comprises the promoter and the 5'-untranslated leader sequence. A 3' regulatory region is a DNA sequence located downstream (i.e., 3') of the coding sequence and which comprises suitable transcription termination (and/or regulation) signals, including one or more polyadenylation signals.

For the purpose of the invention, the promoter is a plant-expressible promoter. As used herein, the term "plant-expressible promoter" means a DNA sequence which is capable of controlling (initiating) transcription in a plant cell. This includes any promoter of plant origin, but also any promoter of non-plant origin which is capable of directing transcription in a plant cell, i.e., certain promoters of viral or bacterial origin Thus, any suitable promoter sequence can be used by the nucleic acid construct of the present invention. According to some embodiments of the invention, the promoter is a constitutive promoter, a tissue-specific promoter or an inducible promoter (e.g. an abiotic stress-inducible promoter).

Suitable constitutive promoters include, for example, hydroperoxide lyase (HPL) promoter, CaMV 35S promoter (Odell et al, Nature 313:810-812, 1985); *Arabidopsis* At6669 promoter (see PCT Publication No.

WO04081173A2); *Arabidopsis* new At6669 promoter; maize Ubi 1 (Christensen et al., Plant Sol. Biol. 18:675-689, 1992); rice actin (McElroy et al., Plant Cell 2:163-171, 1990); pEMU (Last et al, Theor. Appl. Genet. 81:581-588, 1991); CaMV 19S (Nilsson et al, Physiol. Plant 100:456-462, 1997); GOS2 (de Pater et al, Plant J November; 2(6):837-44, 1992); ubiquitin (Christensen et al, Plant MoI. Biol. 18: 675-689, 1992); Rice cyclophilin (Bucholz et al, Plant MoI Biol. 25(5):837-43, 1994); Maize H3 histone (Lepetit et al, MoI. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608,149; 5,608,144; 5,604,121; 5,569,597; 5,466,785; 5,399,680; 5,268,463; and 5,608,142.

Suitable tissue-specific promoters include, but not limited to, leaf-specific promoters [such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant MoI. Biol. 23:1129-1138, 1993; and Matsuoka et al., Proc. Natl. Acad. Sci. USA 90:9586-9590, 1993], seed-preferred promoters [e.g., from seed specific genes (Simon, et al., Plant MoI. Biol. 5. 191, 1985; Scofield, et al., J. Biol. Chem. 262: 12202, 1987; Baszczynski, et al., Plant MoI. Biol. 14: 633, 1990), Brazil Nut albumin (Pearson' et al., Plant MoI. Biol. 18: 235-245, 1992), legumin (Ellis, et al. Plant MoI. Biol. 10: 203-214, 1988), Glutelin (rice) (Takaiwa, et al., MoI. Gen. Genet. 208: 15-22, 1986; Takaiwa, et al., FEBS Letts. 221: 43-47, 1987), Zein (Matzke et al., Plant MoI Biol, 143)323-32 1990), napA (Stalberg, et al., Planta 199: 515-519, 1996), Wheat SPA (Albanietal, Plant Cell, 9: 171-184, 1997), sunflower oleosin (Cummins, et al, Plant MoI. Biol. 19: 873-876, 1992)], endosperm specific promoters [e.g., wheat LMW and HMW, glutenin-1 (MoI Gen Genet. 216:81-90, 1989; NAR 17:461-2), wheat a, b and g gliadins (EMBO3: 1409-15, 1984), Barley ltrl promoter, barley Bl, C, D hordein (Theor Appl Gen 98:1253-62, 1999; Plant J 4:343-55, 1993; MoI Gen Genet. 250:750-60, 1996), Barley DOF (Mena et al., The Plant Journal, 116(1): 53-62, 1998), Biz2 (EP99106056.7), Synthetic promoter (Vicente-Carbajosa et al., Plant J. 13: 629-640, 1998), rice prolamin NRP33, rice-globulin GIb-I (Wu et al., Plant Cell Physiology 39(8) 885-889, 1998), rice alpha-globulin REB/OHP-1 (Nakase et al. Plant MoI. Biol. 33: 513-S22, 1997), rice ADP-glucose PP (Trans Res 6:157-68, 1997), maize ESR gene family (Plant J 12:235-46, 1997), *sorghum* gamma-kafirin (PMB 32:1029-35, 1996); e.g., the Napin promoter], embryo specific promoters [e.g., rice OSH1 (Sato et al, Proc. Natl. Acad. Sci. USA, 93: 8117-8122), KNOX (Postma-Haarsma et al, Plant MoI. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant MoI. Biol. 15, 95-109, 1990), LAT52 (Twell et al., MoI. Gen Genet. 217:240-245; 1989), apetala-3].

Suitable abiotic stress-inducible promoters include, but not limited to, salt-inducible promoters such as RD29A (Yamaguchi-Shinozalei et al., MoI. Gen. Genet. 236:331-340, 1993); drought-inducible promoters such as maize rab17 gene promoter to (PIa et al., Plant MoI. Biol. 21:259-266, 1993), maize rab28 gene promoter (Busk et al., Plant J. 11:1285-1295, 1997) and maize Ivr2 gene promoter (Pelleschi et al., Plant MoI. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to some embodiments of the invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

When naked RNA or DNA is introduced into a cell, the polynucleotides may be synthesis using any method known in the art, including either enzymatic syntheses or solid-phase syntheses. These are especially useful in the case of short polynucleotide sequences with or without modifications as explained above. Equipment and reagents for executing solid-phase synthesis are commercially available from, for example, Applied Biosystems. Any other means for such synthesis may also be employed; the actual synthesis of the oligonucleotides is well within the capabilities of one skilled in the art and can be accomplished via established methodologies as detailed in, for example: Sambrook, J. and Russell, D. W. (2001), "Molecular Cloning: A Laboratory Manual"; Ausubel, R. M. et al., eds. (1994, 1989), "Current Protocols in Molecular Biology," Volumes I-III, John Wiley & Sons, Baltimore, Md.; Perbal, B. (1988), "A Practical Guide to Molecular Cloning," John Wiley & Sons, New York; and Gait, M. J., ed. (1984), "Oligonucleotide Synthesis"; utilizing solid-phase chemistry, e.g. cyanoethyl phosphoramidite followed by deprotection, desalting, and purification by, for example, an automated trityl-on method or HPLC.

There are various methods of introducing foreign genes into both monocotyledonous and dicotyledonous plants (Potrykus, L, Annu. Rev. Plant. Physiol, Plant. MoI. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer (e.g., T-DNA using *Agrobacterium tumefaciens* or *Agrobacterium rhizogenes*); see for example, Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure to which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

According to a specific embodiment of the present invention, the exogenous polynucleotide is introduced into the plant by infecting the plant with a bacteria, such as using a floral dip transformation method (as described in further detail in Example 5, of the Examples section which follows).

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. For this reason it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a to rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

Although stable transformation is presently preferred, transient transformation of leaf cells, meristematic cells or the whole plant is also envisaged by the present invention.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261. According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Galon et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al, Virology (1989) 172:

285-292; Takamatsu et al. EMBO J. (1987) 6:307-311; French et al. Science (1986) 231:1294-1297; Takamatsu et al. FEB S Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat proteins which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral nucleic acid is provided in which the native coat protein coding sequence has been deleted from a viral nucleic acid, a non-native plant viral coat protein coding sequence and a non-native promoter, preferably the to subgenomic promoter of the non-native coat protein coding sequence, capable of expression in the plant host, packaging of the recombinant plant viral nucleic acid, and ensuring a systemic infection of the host by the recombinant plant viral nucleic acid, has been inserted. Alternatively, the coat protein gene may be inactivated by insertion of the non-native nucleic acid sequence within it, such that a protein is produced. The recombinant plant viral nucleic acid may contain one or more additional non-native subgenomic promoters. Each non-native subgenomic promoter is capable of transcribing or expressing adjacent genes or nucleic acid sequences in the plant host and incapable of recombination with each other and with native subgenomic promoters. Non-native (foreign) nucleic acid sequences may be inserted adjacent the native plant viral subgenomic promoter or the native and a non-native plant viral subgenomic promoters if more than one nucleic acid sequence is included. The non-native nucleic acid sequences are transcribed or expressed in the host plant under control of the subgenomic promoter to produce the desired products.

In a second embodiment, a recombinant plant viral nucleic acid is provided as in the first embodiment except that the native coat protein coding sequence is placed adjacent one of the non-native coat protein subgenomic promoters instead of a non-native coat protein coding sequence.

In a third embodiment, a recombinant plant viral nucleic acid is provided in which the native coat protein gene is adjacent its subgenomic promoter and one or more non-native subgenomic promoters have been inserted into the viral nucleic acid. The inserted non-native subgenomic promoters are capable of transcribing or expressing adjacent genes in a plant host and are incapable of recombination with each other and with native subgenomic promoters. Non-native nucleic acid sequences may be inserted adjacent the non-native subgenomic plant viral promoters such that the sequences are transcribed or expressed in the host plant under control of the subgenomic promoters to produce the desired product.

In a fourth embodiment, a recombinant plant viral nucleic acid is provided as in the third embodiment except that the native coat protein coding sequence is replaced by a non-native coat protein coding sequence.

The viral vectors are encapsidated by the coat proteins encoded by the recombinant plant viral nucleic acid to produce a recombinant plant virus. The recombinant plant viral nucleic acid or recombinant plant virus is used to infect appropriate host plants. The recombinant plant viral nucleic acid is capable of replication in the host, systemic spread in the host, and transcription or expression of foreign gene(s) (isolated nucleic acid) in the host to produce the desired protein.

In addition to the above, the nucleic acid molecule of the present invention can also be introduced into a chloroplast genome thereby enabling chloroplast expression.

A technique for introducing exogenous nucleic acid sequences to the genome of the chloroplasts is known. This technique involves the following procedures. First, plant cells are chemically treated so as to reduce the number of chloroplasts per cell to about one. Then, the exogenous nucleic acid is introduced via particle bombardment into the cells with the aim of introducing at least one exogenous nucleic acid molecule into the chloroplasts. The exogenous nucleic acid is selected such that it is integratable into the chloroplast's genome via homologous recombination which is readily effected by enzymes inherent to the chloroplast. To this end, the exogenous nucleic acid includes, in addition to a gene of interest, at least one nucleic acid stretch which is derived from the chloroplast's genome. In addition, the exogenous nucleic acid includes a selectable marker, which serves by sequential selection procedures to ascertain that all or substantially all of the copies of the chloroplast genomes following such selection will include the exogenous nucleic acid. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since tolerance to abiotic stress as well as yield, vigor or biomass of the plant can involve multiple genes acting additively or in synergy (see, for example, in Quesda et al., Plant Physiol. 130:951-063, 2002), the invention also envisages expressing a plurality of exogenous polynucleotides in a single host plant to thereby achieve superior effect on tolerance to abiotic stress, yield, vigor and biomass of the plant.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove. Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides can be regenerated into a mature plant, using the methods described hereinabove.

Alternatively, expressing a plurality of exogenous polynucleotides can be effected by introducing different nucleic acid constructs, including different exogenous polynucleotides, into a plurality of plants. The regenerated transformed plants can then be cross-bred and resultant progeny selected for superior yield (e.g., tolerance to abiotic stres), using conventional plant breeding techniques.

According to some embodiments of the invention, the plant expressing the exogenous polynucleotide(s) is grown under non-stress or normal conditions (e.g., biotic conditions and/or conditions with sufficient water, nutrients such as nitrogen and fertilizer). Such conditions, which depend on the plant being grown, are known to those skilled in the art of agriculture, and are further, described above.

According to some embodiments of the invention, the method further comprises growing the plant expressing the exogenous polynucleotide(s) under abiotic stress. Non-limiting examples of abiotic stress conditions include, water deprivation, drought, excess of water (e.g., flood, waterlogging), freezing, low temperature, high temperature, to strong winds, heavy metal toxicity, anaerobiosis, nutrient deficiency, nutrient excess, salinity, atmospheric pollution, intense light, insufficient light, or UV irradiation, etiolation and atmospheric pollution.

Thus, the invention encompasses plants exogenously expressing the polynucleotide(s), the nucleic acid constructs and/or polypeptide(s) of the invention. Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-m situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., tolerance to abiotic stress). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); to selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention can be screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct; and (b) evaluating a trait of a plant as compared to a wild type plant of the same type; thereby evaluating the trait of the plant.

Thus, the effect of the transgene (the exogenous polynucleotide encoding the polypeptide) on different plant characteristics may be determined any method known to one of ordinary skill in the art.

Thus, for example, tolerance to abiotic stress may be compared in transformed plants {i.e., expressing the transgene) compared to non-transformed (wild type) plants exposed to the same abiotic stress conditions (e.g. water deprivation, salt stress e.g. salinity, suboptimal temperature, nutrient deficiency, nutrient excess, osmotic stress, and the like), using the following assays (also described in Examples 7 of the Examples section which follows):

Drought tolerance assay—Soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as drought stress tolerant plants Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution with added salt), or by culturing the plants in a hyperosmotic growth medium [e.g., 50% Murashige-Skoog medium (MS medium) with added salt]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 150 mM, 300 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of chlorosis and overall success to reach maturity and yield progeny are compared between control and transgenic plants. Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and PEG assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress experiments, the medium is supplemented for example with 50 mM, 100 mM, 200 mM NaCl or 15%, 20% or 25% PEG.

Cold stress tolerance—One way to analyze cold stress is as follows. Mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between control and transgenic plants, by measuring plant weight (wet and dry), and by comparing growth rates measured as time to flowering, plant size, yield, and the like.

Heat stress tolerance—One way to measure heat stress tolerance is by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

The biomass, vigor and yield of the plant can also be evaluated using any method known to one of ordinary skill in the art. Thus, for example, plant vigor can be calculated by the increase in growth parameters such as leaf area, fiber length, rosette diameter, plant fresh weight and the like per time.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number to of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Thus, the present invention is of high agricultural value for increasing tolerance of plants to abiotic stress as well as promoting the yield, biomass and vigor of commercially desired crops.

According to another embodiment of the present invention, there is provided a food or feed comprising the plants or a portion thereof of the present invention.

In a further aspect the invention, the transgenic plants of the present invention or parts thereof are comprised in a food or feed product (e.g., dry, liquid, paste). A food or feed product is any ingestible preparation containing the transgenic plants, or parts thereof, of the present invention, or preparations made from these plants. Thus, the plants or preparations are suitable for human (or animal) consumption, i.e. the transgenic plants or parts thereof are more readily digested. Feed products of the present invention further include a oil or a beverage adapted for animal consumption.

It will be appreciated that the transgenic plants, or parts thereof, of the present invention may be used directly as feed products or alternatively may be incorporated or mixed with feed products for consumption. Furthermore, the food or feed products may be processed or used as is. Exemplary feed products comprising the transgenic plants, or parts thereof, include, but are not limited to, grains, cereals, such as oats, e.g. black oats, barley, wheat, rye, sorghum, corn, vegetables, leguminous plants, especially soybeans, root vegetables and cabbage, or green forage, such as grass or hay.

As used herein the term "about" refers to ±10%.

The terms "comprises", "comprising", "includes", "including", "having" and their conjugates mean "including but not limited to".

The term "consisting of means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references to unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless to the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions, illustrate the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in to Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Materials and Experimental Procedures

Plant Material

Corn seeds were obtained from Galil seeds (Israel). Corn variety 5605 was used in all experiments. Plants were grown at 28° C. under a 16 hours light:8 hours dark regime.

Stress Induction

Plants were grown under standard conditions as described above until seedlings were two weeks old. Next, plants were divided into three groups: control plants were irrigated with tap water twice weekly, salinity-treated plants were irrigated with tap water spiked with 150 or 300 mM NaCl, as specified in Tables 2-5 (below), twice weekly, and drought-treated plants received no irrigation. The experiment continued as described in the specific examples, after which plants were harvested for RNA extraction.

Total RNA Extraction

Total RNA of leaf or root samples from five to six biological repeats were extracted using the mirVana™ kit (Ambion, Austin, Tex.) as follows:

Samples were ground with liquid nitrogen and the resulting powder (300-400 mg) was placed in a 13-ml tube. Lysis buffer (2 ml) and homogenate additive (200 µl) were added, mixed well and incubated for 10 min on ice. Samples were extracted twice with a volume of acid phenol-chloroform (2 ml), vortexed for 30-60 s and centrifuged for 5 min at 12,000 g. Samples were further extracted with one volume of chloroform:isoamyl 24:1, and the aqueous phase was transferred to a fresh 13-ml tube. Ethanol (100%, 1.25 volumes) was added to the aqueous phase and the mixture was loaded onto a column in 700 µl aliquots.

The column was washed once with Wash Solution 1 (650 µl) and twice more with Wash Solution ⅔ (500 µl). Next, the column was centrifuged for 1 min to remove residual fluid and the column was transferred to a new collection tube. RNAse-free water (100 µl), pre-heated to 95° C., was added to the column and the column was centrifuged for 1 min at 14,000 rpm. The elution step was performed twice with the same water.

RNA concentration was measured using an ND-1000 Spectrophotometer (NanoDrop, USA). DNase Turbo® (Ambion Inc., USA) was added at 1 µl enzyme per 10 µg RNA and the mixture was incubated for 60 min at 37° C. An equal volume of acid phenol-chloroform was added, and the samples were vortexed and centrifuged for 10 min at 12,000 g. The upper phase was transferred to a new tube, and a 10% volume of NaOAc 3 M, pH 5.2, was added, followed by three volumes of 100% ethanol. Tubes were incubated overnight at −20° C. and precipitated by centrifugation at 4° C. for 40 min at 14,000 rpm. The supernatant was removed and washed with 0.5 ml of 85% cold ethanol. The pellet was dried and re-suspended in 50 μl of RNAse-free water.

Database

MicroRNA sequences were derived from versions 10.1 and 14 of miRBase (released December 2007) and comprise the 673 non-redundant sequences defined as "Viridiplantae" and the 47 sequences submitted for C. reinhardtii.

Microarray Design

Custom microarrays were manufactured by Agilent Technologies by in situ synthesis of DNA oligonucleotide probes for 890 plant and algal microRNAs, with each probe being printed in triplicate.

Fourteen negative control probes were designed using the sense sequences of different microRNAs, chosen from different plants and algae. Two groups of positive-control probes were used: (i) synthetic small RNA that were spiked to the RNA before labeling to verify the labeling efficiency, and (ii) probes for abundant small nuclear RNAs (U1, U2, U3, U4, U5, U6, for three plant species and for C. reinhardtii) were spotted on the array to verify the quantity and quality of the RNAs.

Microarray Hybridization and Scanning

Five micrograms of total RNA were labeled by ligation of Cy3 or Cy5 to the 3' end. The labeled RNA was mixed with 3× hybridization buffer (Ambion, Austin, Tex.) and hybridized with the slides for 12-16 h in an Agilent Rotational oven at 10-13 rpm. Following hybridization, the arrays were washed twice at room temperature with 1×SSC and 0.2% SDS. Next, the arrays were washed in 0.1×SSC followed by a 1 min wash in fresh Agilent Stabilization and Drying solution (Agilent, Santa Clara, Calif.).

Array Signal Calculation and Normalization

Array images were analyzed using the Feature Extraction software (FE) 9.5.1 (Agilent, Santa Clara, Calif.). Experiments were repeated four times and triplicate spots were combined to produce one signal for each probe by taking the logarithmic mean of reliable spots. All data were log-transformed (natural base) and the analysis was performed in log-space. A reference data vector for normalization R was calculated by taking the median expression level for each probe across nitrogen starvation samples. For each sample data vector S, a 2nd degree polynomial F was found, in order to provide the best fit between the sample data and the reference data, such that $R \approx F(S)$. For each probe in the sample (element $S_i$ in the vector S), the normalized value (in log-space) $M_i$ was calculated from the initial value $S_i$ by transforming it with the polynomial function F, so that $M_i = F(S_i)$. P-values were calculated using a two-sided t-test on the log-transformed normalized fluorescence signal. The fold-difference (ratio of the median normalized fluorescence) was calculated for each microRNA.

Quantitative Real-Time PCR

Differentially expressed microRNAs related to resistance to abiotic stress were identified and validated by qPCR. RNA was subjected to a polyadenylation reaction as previously described 1Shi R, Chiang V L, Biotechniques (2005) 39:519-5251. Briefly, RNA was incubated in the presence of a poly A polymerase enzyme (Takara, Otsu Japan), $MnCl_2$, and ATP for 1 h at 37° C. Then, using an oligo dT primer harboring a consensus sequence, reverse transcription was performed on total RNA using SuperScript II RT (Invitrogen, Carlsbad, Calif.). Next, the cDNA was amplified by real-time PCR; this reaction contained a microRNA-specific forward primer and a universal reverse primer complementary to the consensus 3' sequence of the oligo dT tail. Results represent the median of four repeats with each one done in triplicate, and the signal was normalized against the median of three reference microRNAs.

Example 1

Differential Expression of miRNAs in Corn Plants after One Week of Drought or High Salinity Conditions Corn plants were first allowed to grow at standard, optimal conditions for two weeks. Plants were subsequently divided into three groups: control, salinity- and drought-treated. The control group was irrigated to saturation, twice weekly with tap water. The salinity group was irrigated twice weekly with tap water spiked with 150 mM NaCl. The drought group was not irrigated. The experiment continued for one week, after which plants were harvested. Two to three plants from each treatment were grouped as a biological repeat. Five to six repeats were obtained for each treatment, and RNA was extracted from leaf tissue.

The expression level of the corn microRNAs was analyzed by high throughput microarray to identify microRNAs that were differentially expressed in response to drought or salinity. Several members of the miR-169 family were found to be down-regulated in response to drought stress. Several members of the miR-167 family were found to be up-regulated and several members of the miR-169 family were found to be down-regulated in response to salinity stress. The results are presented in Table 2 below:

TABLE 2

Differentially-expressed microRNAs in corn plants after one week of treatment

| MicroRNA | P value | Fold Change | Direction | Treatment | miR SEQ ID NO | Hairpin SEQ ID NO |
|---|---|---|---|---|---|---|
| osa-miR169e | 7.7e−003 | 1.58 | Down | 150 mM NaCl | 1 | 11 |
| ath-miR169a | 8.6e−003 | 1.58 | Down | 150 mM NaCl | 2 | 12 |
| ptc-miR169o | 1.0e−002 | 1.56 | Down | 150 mM NaCl | 3 | 13 |
| bna-miR169c | 1.1e−002 | 1.53 | Down | 150 mM NaCl | 4 | 14 |
| ptc-miR169v | 1.1e−002 | 1.52 | Down | 150 mM NaCl | 5 | 15 |
| ath-miR169d | 1.6e−002 | 1.53 | Down | 150 mM NaCl | 6 | 16 |
| ath-miR167c | 2.1e−002 | 1.57 | Up | 150 mM NaCl | 7 | 17 |
| bna-miR167a | 3.0e−002 | 1.51 | Up | 150 mM NaCl | 8 | 18 |
| ppt-miR167 | 3.3e−002 | 1.68 | Up | 150 mM NaCl | 9 | 19 |
| ptc-miR167f | 3.7e−002 | 1.54 | Up | 150 mM NaCl | 10 | 20 |
| ppt-miR894 | 3.4e−003 | 1.81 | Down | 150 mM NaCl | 21 | 26 |
| osa-miR164e | 1.4e−002 | 1.96 | Up | 1 week drought | 22 | 27 |

TABLE 2-continued

Differentially-expressed microRNAs in corn plants after one week of treatment

| MicroRNA | P value | Fold Change | Direction | Treatment | miR SEQ ID NO | Hairpin SEQ ID NO |
|---|---|---|---|---|---|---|
| bna-miR169g | 4.2e−003 | 2.03 | Down | 1 week drought | 23 | 28 |
| ptc-miR169o | 1.9e−003 | 2.00 | Down | 1 week drought | 3 | 13 |
| ptc-miR169v | 3.4e−003 | 1.89 | Down | 1 week drought | 5 | 15 |
| osa-miR169e | 1.4e−003 | 1.72 | Down | 1 week drought | 1 | 11 |
| ath-miR169d | 1.4e−003 | 1.68 | Down | 1 week drought | 6 | 16 |
| ath-miR169a | 4.9e−004 | 1.68 | Down | 1 week drought | 2 | 12 |
| vvi-miR169m | 1.0e−003 | 1.57 | Down | 1 week drought | 24 | 29 |
| ptc-miR169q | 1.4e−003 | 1.54 | Down | 1 week drought | 25 | 30 |

Example 2

Differential Expression of miRNAs in Corn Plants after Two Weeks of Drought or High Saline Conditions Corn plants were first allowed to grow at standard, optimal conditions for two to weeks. Plants were subsequently divided into three groups: control, salinity- and drought-treated. The control group was watered to saturation twice weekly with tap water. The salinity group was irrigated twice weekly with tap water spiked with 150 mM NaCl. The drought group was not irrigated. The experiment continued for two weeks, after which plants were harvested. Two to three plants from each treatment were grouped as a biological repeat. Five to six repeats were obtained for each treatment, and RNA was extracted from leaf tissue.

The expression level of the corn microRNAs was analyzed by high throughput microarray to identify microRNAs that are differentially expressed in response to drought or salinity. Several members of the miR-156 family were found to be up-regulated in response to both salt and drought stress. Several members of the miR-171 family were found to be down-regulated under drought stress. ath-miR854a was found to be down-regulated under both stresses. The results are presented in Table 3 below:

TABLE 3

Differentially-expressed microRNAs in corn plants after two weeks of treatment

| MicroRNA | P value | Fold Change | Direction | Treatment | miR SEQ ID NO | Hairpin SEQ ID NO |
|---|---|---|---|---|---|---|
| Table 3A: Leaf samples ||||||||
| bna-miR156a | 1.3e−002 | 1.60 | Up | 150 mM NaCl | 31 | 49 |
| ath-miR156g | 2.6e−002 | 1.58 | Up | 150 mM NaCl | 32 | 50 |
| osa-miR156l | 4.4e−002 | 1.56 | Up | 150 mM NaCl | 33 | 51 |
| ath-miR854a | 1.5e−002 | 1.53 | Down | 150 mM NaCl | 34 | 52 |
| ppt-miR1039-3p | 3.7e−004 | 7.94 | Up | 2 weeks drought | 35 | 53 |
| osa-miR156l | 5.4e−006 | 4.31 | Up | 2 weeks drought | 33 | 51 |
| bna-miR156a | 2.1e−005 | 4.14 | Up | 2 weeks drought | 31 | 49 |
| ath-miR156g | 8.7e−007 | 3.54 | Up | 2 weeks drought | 32 | 50 |
| zma-miR156k | 2.2e−005 | 3.38 | Up | 2 weeks drought | 36 | 54 |
| vvi-miR156e | 4.3e−004 | 3.31 | Up | 2 weeks drought | 37 | 55 |
| sbi-miR156d | 3.9e−003 | 1.87 | Up | 2 weeks drought | 38 | 56 |
| ath-miR167d | 6.2e−003 | 1.63 | Up | 2 weeks drought | 39 | 57 |
| ptc-miR167h | 2.3e−002 | 1.76 | Up | 2 weeks drought | 40 | 58 |
| sbi-miR168 | 4.7e−004 | 1.68 | Up | 2 weeks drought | 41 | 59 |
| gma-miR168 | 2.6e−003 | 1.56 | Up | 2 weeks drought | 42 | 60 |
| sof-miR408a | 1.6e−002 | 1.90 | Up | 2 weeks drought | 43 | 61 |
| ath-miR408 | 2.5e−002 | 1.73 | Up | 2 weeks drought | 44 | 62 |
| ppt-miR160b | 1.7e−004 | 1.50 | Down | 2 weeks drought | 45 | 63 |
| ppt-miR160c | 6.7e−004 | 1.69 | Down | 2 weeks drought | 46 | 64 |
| osa-miR390 | 1.6e−002 | 2.67 | Down | 2 weeks drought | 47 | 65 |
| ppt-miR390c | 2.0e−002 | 2.53 | Down | 2 weeks drought | 48 | 66 |
| ath-miR854a | 1.1e−003 | 1.88 | Down | 2 weeks drought | 34 | 52 |
| Table 3B: Root samples ||||||||
| smo-miR171a | 7.4e−003 | 1.61 | Down | 2 weeks drought | 74 | 68 |
| smo-miR171b | 1.4e−002 | 1.62 | Down | 2 weeks drought | 75 | 69 |
| sbi-miR171b | 1.5e−002 | 1.57 | Down | 2 weeks drought | 76 | 70 |
| zma-miR171c | 4.4e−002 | 1.51 | Down | 2 weeks drought | 77 | 71 |
| zma-miR171f | 2.3e−002 | 1.59 | Down | 2 weeks drought | 78 | 72 |
| ath-miR854a | 3.2e−002 | 1.60 | Down | 2 weeks drought | 34 | 52 |
| ppt-miR894 | 1.6e−002 | 1.55 | Down | 2 weeks drought | 21 | 26 |

Example 3

Differential Expression of miRNAs in Sorghum Plants after Two Weeks of Drought or High Saline Conditions

*Sorghum bicolor* plants were first allowed to grow at standard, optimal conditions for two weeks. Plants were subsequently divided into three groups: control, salinity- and drought-treated. The control group was watered to saturation twice a week with tap water. The salinity group was irrigated twice weekly with tap water spiked with 150 mM NaCl. The drought group was not irrigated. The experiment continued for two weeks, after which plants were harvested. Two to three plants from each treatment were grouped as a biological repeat. Five to six repeats were obtained for each treatment, and RNA was extracted from leaf tissue.

The expression level of the *sorghum* microRNAs was analyzed by high throughput microarray to identify microRNAs that were differentially expressed in response to drought or salinity. Several members of the miR-529, miR-164 and miR-159 families were found to be up-regulated under drought stress. Several members of the miR-169 families were found to be down-regulated under drought stress. Several members of the miR-156 family were found to be up-regulated in response to both salt and drought stress, and several members of the miR-171 and miR-172 families were found to be down-regulated under both stresses. The results are presented in Table 4 below:

TABLE 4

Differentially-expressed microRNAs in sorghum plants after two weeks of treatment

| MicroRNA | P value | Fold Change | Direction | Treatment | miR SEQ ID NO | Hairpin SEQ ID NO |
|---|---|---|---|---|---|---|
| Table 4A: Leaf samples ||||||||
| smo-miR156c | 2.8e−003 | 3.30 | Up | 150 mM NaCl | 79 | 137 |
| smo-miR156d | 9.9e−006 | 5.23 | Up | 150 mM NaCl | 80 | 138 |
| zma-miR156k | 2.3e−002 | 2.07 | Up | 150 mM NaCl | 36 | 54 |
| ppt-miR395 | 3.6e−003 | 3.43 | Up | 150 mM NaCl | 81 | 139 |
| ppt-miR1039-3p | 3.8e−003 | 2.73 | Up | 150 mM NaCl | 35 | 53 |
| smo-miR1091 | 3.6e−003 | 3.74 | Up | 150 mM NaCl | 82 | 140 |
| tae-miR1118 | 4.0e−004 | 5.92 | Up | 150 mM NaCl | 83 | 141 |
| tae-miR1134 | 8.3e−003 | 3.29 | Up | 150 mM NaCl | 84 | 142 |
| sbi-miR171b | 1.4e−003 | 2.38 | Down | 150 mM NaCl | 76 | 70 |
| smo-miR171a | 3.6e−003 | 2.02 | Down | 150 mM NaCl | 74 | 68 |
| smo-miR171b | 1.2e−003 | 2.16 | Down | 150 mM NaCl | 75 | 69 |
| vvi-miR171a | 1.0e−003 | 2.30 | Down | 150 mM NaCl | 85 | 143 |
| vvi-miR171i | 8.8e−004 | 2.11 | Down | 150 mM NaCl | 86 | 144 |
| zma-miR171c | 5.1e−003 | 2.20 | Down | 150 mM NaCl | 77 | 71 |
| zma-miR171f | 1.3e−003 | 2.10 | Down | 150 mM NaCl | 78 | 72 |
| gma-miR172a | 6.9e−004 | 2.38 | Down | 150 mM NaCl | 87 | 145 |
| ath-miR172c | 4.0e−003 | 2.55 | Down | 150 mM NaCl | 88 | 146 |
| zma-miR172e | 1.0e−002 | 2.12 | Down | 150 mM NaCl | 89 | 147 |
| sbi-miR399b | 2.2e−002 | 2.31 | Down | 150 mM NaCl | 90 | 148 |
| osa-miR530-3p | 2.1e−003 | 6.91 | Down | 150 mM NaCl | 91 | 149 |
| ath-miR854a | 6.8e−003 | 2.24 | Down | 150 mM NaCl | 34 | 52 |
| smo-miR156c | 4.4e−003 | 3.04 | Up | 2 weeks drought | 79 | 137 |
| smo-miR156d | 3.7e−004 | 6.36 | Up | 2 weeks drought | 80 | 138 |
| ppt-miR395 | 5.5e−003 | 3.77 | Up | 2 weeks drought | 81 | 139 |
| ppt-miR529a | 5.5e−003 | 2.66 | Up | 2 weeks drought | 92 | 150 |
| ppt-miR529d | 3.2e−003 | 2.25 | Up | 2 weeks drought | 93 | 151 |
| ppt-miR529e | 1.8e−003 | 2.53 | Up | 2 weeks drought | 94 | 152 |
| ppt-miR529g | 1.0e−002 | 2.18 | Up | 2 weeks drought | 95 | 153 |
| ppt-miR1039-3p | 1.5e−004 | 5.49 | Up | 2 weeks drought | 35 | 53 |
| smo-miR1091 | 1.3e−003 | 5.81 | Up | 2 weeks drought | 82 | 140 |
| tae-miR1118 | 1.7e−003 | 7.64 | Up | 2 weeks drought | 83 | 141 |
| tae-miR1134 | 8.4e−003 | 4.24 | Up | 2 weeks drought | 84 | 142 |
| osa-miR169a | 2.6e−002 | 2.01 | Down | 2 weeks drought | 96 | 154 |
| sbi-miR169b | 1.8e−002 | 2.00 | Down | 2 weeks drought | 97 | 155 |
| bna-miR169m | 1.1e−002 | 2.37 | Down | 2 weeks drought | 98 | 156 |
| vvi-miR171a | 7.4e−003 | 2.52 | Down | 2 weeks drought | 85 | 143 |
| sbi-miR171b | 5.6e−004 | 2.43 | Down | 2 weeks drought | 76 | 70 |
| zma-miR171c | 3.4e−003 | 2.28 | Down | 2 weeks drought | 77 | 71 |
| gma-miR172a | 1.8e−002 | 2.22 | Down | 2 weeks drought | 87 | 145 |
| ath-miR172c | 2.6e−002 | 2.27 | Down | 2 weeks drought | 88 | 146 |
| zma-miR172e | 3.5e−002 | 2.06 | Down | 2 weeks drought | 89 | 147 |
| ath-miR395a | 4.4e−002 | 2.56 | Down | 2 weeks drought | 99 | 157 |
| bna-miR397a | 1.2e−002 | 2.97 | Down | 2 weeks drought | 100 | 158 |
| ptc-miR397b | 9.1e−003 | 3.28 | Down | 2 weeks drought | 101 | 159 |
| smo-miR408 | 1.3e−003 | 2.57 | Down | 2 weeks drought | 102 | 160 |
| osa-miR528 | 2.5e−003 | 2.71 | Down | 2 weeks drought | 103 | 161 |
| osa-miR530-3p | 9.9e−006 | 14.00 | Down | 2 weeks drought | 91 | 149 |
| Table 4B: Root samples ||||||||
| smo-miR171a | 2.4e−003 | 2.26 | Down | 150 mM NaCl | 74 | 68 |
| vvi-miR171a | 7.1e−004 | 2.18 | Down | 150 mM NaCl | 85 | 143 |
| ath-miR171b | 3.7e−004 | 2.39 | Down | 150 mM NaCl | 104 | 162 |

TABLE 4-continued

Differentially-expressed microRNAs in sorghum plants after two weeks of treatment

| MicroRNA | P value | Fold Change | Direction | Treatment | miR SEQ ID NO | Hairpin SEQ ID NO |
|---|---|---|---|---|---|---|
| sbi-miR171b | 1.1e−003 | 2.09 | Down | 150 mM NaCl | 76 | 70 |
| smo-miR171b | 2.4e−003 | 2.43 | Down | 150 mM NaCl | 75 | 69 |
| zma-miR171f | 2.7e−003 | 2.22 | Down | 150 mM NaCl | 78 | 72 |
| ppt-miR896 | 5.6e−003 | 2.17 | Down | 150 mM NaCl | 105 | 163 |
| smo-miR156d | 2.8e−002 | 2.02 | Up | 2 weeks drought | 80 | 138 |
| pta-miR159c | 7.0e−005 | 7.12 | Up | 2 weeks drought | 106 | 164 |
| sof-miR159c | 1.7e−003 | 2.84 | Up | 2 weeks drought | 107 | 165 |
| osa-miR159c | 2.3e−003 | 2.29 | Up | 2 weeks drought | 108 | 166 |
| osa-miR159d | 4.0e−003 | 2.20 | Up | 2 weeks drought | 109 | 167 |
| osa-miR164a | 5.4e−004 | 2.41 | Up | 2 weeks drought | 110 | 168 |
| sbi-miR164b | 2.9e−004 | 2.47 | Up | 2 weeks drought | 111 | 169 |
| osa-miR164c | 1.7e−004 | 2.48 | Up | 2 weeks drought | 112 | 170 |
| ptc-miR164f | 1.4e−004 | 2.60 | Up | 2 weeks drought | 113 | 171 |
| ppt-miR1039-3p | 1.9e−003 | 5.10 | Up | 2 weeks drought | 35 | 53 |
| tae-miR1129 | 1.1e−002 | 2.16 | Up | 2 weeks drought | 114 | 172 |
| sbi-miR169c | 2.9e−002 | 2.11 | Down | 2 weeks drought | 117 | 175 |
| sbi-miR169i | 2.9e−003 | 4.19 | Down | 2 weeks drought | 118 | 176 |
| ptc-miR169x | 3.7e−002 | 2.22 | Down | 2 weeks drought | 119 | 177 |
| smo-miR171a | 6.7e−003 | 2.06 | Down | 2 weeks drought | 74 | 68 |
| smo-miR171b | 5.9e−003 | 2.16 | Down | 2 weeks drought | 75 | 69 |
| smo-miR408 | 7.6e−003 | 2.16 | Down | 2 weeks drought | 102 | 160 |

Example 4

Differential Expression of miRNAs in Corn Plants after Six Days of Drought or High Saline Conditions Corn plants were first allowed to grow at standard, optimal conditions for two weeks. Plants were subsequently divided into three groups: control, salinity- and drought-treated. The control group was watered to saturation twice weekly with tap to water. The salinity group was irrigated twice weekly with tap water spiked with 300 mM NaCl. The drought group was not irrigated. The experiment continued for six days after, which plants were harvested. Two to three plants from each treatment were grouped as a biological repeat. Five to six repeats were obtained for each treatment, and RNA was extracted from leaf tissue.

The expression level of the corn microRNAs was analyzed by high throughput microarray to identify microRNAs that were differentially expressed in response to drought or salinity. Several members of the miR-156 family were found to be up-regulated under drought stress. Several members of the miR-167 family were found to be up-regulated under salt stress. Several members of the miR-164 family were found to be up-regulated in response to both salt and drought stress, and several members of the miR-399 family were found to be down-regulated under both stresses. The results are presented in Table 5 below:

TABLE 5

Differentially-expressed microRNAs in corn plants after six days of treatment

| MicroRNA | P value | Fold Change | Direction | Treatment | miR SEQ ID NO | Hairpin SEQ ID NO |
|---|---|---|---|---|---|---|
| Table 5A: Leaf samples | | | | | | |
| ath-miR156g | 4.5e−002 | 2.61 | Up | 300 mM NaCl | 32 | 50 |
| ptc-miR164f | 4.4e−002 | 1.60 | Up | 300 mM NaCl | 113 | 171 |
| ath-miR167c | 2.6e−003 | 1.76 | Up | 300 mM NaCl | 7 | 17 |
| ath-miR167d | 5.8e−003 | 1.64 | Up | 300 mM NaCl | 39 | 57 |
| ptc-miR167f | 9.6e−003 | 1.59 | Up | 300 mM NaCl | 10 | 20 |
| ptc-miR167h | 1.2e−002 | 1.67 | Up | 300 mM NaCl | 40 | 58 |
| ppt-miR1039-3p | 2.6e−006 | 2.58 | Up | 300 mM NaCl | 35 | 53 |
| sbi-miR171e | 2.7e−005 | 5.46 | Down | 300 mM NaCl | 120 | 178 |
| sbi-miR171f | 1.5e−006 | 5.42 | Down | 300 mM NaCl | 121 | 179 |
| osa-miR390 | 1.1e−003 | 1.91 | Down | 300 mM NaCl | 47 | 65 |
| sbi-miR399b | 1.3e−004 | 3.47 | Down | 300 mM NaCl | 90 | 148 |
| mtr-miR399d | 1.2e−004 | 3.06 | Down | 300 mM NaCl | 122 | 180 |
| smo-miR408 | 4.4e−003 | 1.92 | Down | 300 mM NaCl | 102 | 160 |
| ppt-miR477a-3p | 1.2e−002 | 1.71 | Down | 300 mM NaCl | 123 | 181 |
| osa-miR528 | 1.9e−004 | 4.31 | Down | 300 mM NaCl | 103 | 161 |
| ath-miR855 | 2.5e−003 | 2.54 | Down | 300 mM NaCl | 124 | 182 |
| ppt-miR1026a | 9.2e−003 | 1.98 | Down | 300 mM NaCl | 125 | 183 |
| bna-miR156a | 1.7e−003 | 2.62 | Up | 6 days drought | 31 | 49 |
| ath-miR156g | 1.8e−003 | 2.44 | Up | 6 days drought | 32 | 50 |
| osa-miR156l | 2.1e−003 | 2.68 | Up | 6 days drought | 33 | 51 |

TABLE 5-continued

Differentially-expressed microRNAs in corn plants after six days of treatment

| MicroRNA | P value | Fold Change | Direction | Treatment | miR SEQ ID NO | Hairpin SEQ ID NO |
|---|---|---|---|---|---|---|
| zma-miR156k | 2.4e−003 | 2.33 | Up | 6 days drought | 36 | 54 |
| osa-miR164a | 3.0e−003 | 1.90 | Up | 6 days drought | 110 | 168 |
| sbi-miR164b | 1.6e−003 | 1.97 | Up | 6 days drought | 111 | 169 |
| ptc-miR164f | 2.6e−003 | 1.97 | Up | 6 days drought | 113 | 171 |
| ppt-miR1039-3p | 4.6e−004 | 1.61 | Up | 6 days drought | 35 | 53 |
| sbi-miR171f | 4.7e−004 | 1.78 | Down | 6 days drought | 121 | 179 |
| sbi-miR399b | 1.2e−002 | 1.98 | Down | 6 days drought | 90 | 148 |
| osa-miR528 | 1.4e−003 | 2.34 | Down | 6 days drought | 103 | 161 |
| ath-miR855 | 1.8e−003 | 2.08 | Down | 6 days drought | 124 | 182 |
| ppt-miR901 | 2.6e−002 | 2.04 | Down | 6 days drought | 126 | 184 |
| Table 5B: Root samples | | | | | | |
| osa-miR164a | 9.6e−004 | 1.67 | Up | 300 mM NaCl | 110 | 168 |
| sbi-miR164b | 1.7e−003 | 1.63 | Up | 300 mM NaCl | 111 | 169 |
| osa-miR164c | 3.0e−003 | 1.62 | Up | 300 mM NaCl | 112 | 170 |
| tae-miR1129 | 4.1e−003 | 1.57 | Up | 300 mM NaCl | 114 | 172 |
| ppt-miR1039-3p | 4.7e−003 | 2.87 | Up | 300 mM NaCl | 35 | 53 |
| sbi-miR166e | 5.1e−003 | 1.93 | Down | 300 mM NaCl | 127 | 185 |
| osa-miR390 | 3.8e−005 | 1.86 | Down | 300 mM NaCl | 47 | 65 |
| sbi-miR399a | 1.5e−004 | 2.38 | Down | 300 mM NaCl | 128 | 186 |
| mtr-miR399d | 3.5e−004 | 2.67 | Down | 300 mM NaCl | 122 | 180 |
| sbi-miR399b | 1.2e−004 | 2.61 | Down | 300 mM NaCl | 90 | 148 |
| ptc-miR156k | 1.8e−004 | 1.58 | Up | 6 days drought | 129 | 187 |
| osa-miR164a | 2.7e−004 | 1.52 | Up | 6 days drought | 110 | 168 |
| sbi-miR164b | 1.5e−004 | 1.52 | Up | 6 days drought | 111 | 169 |
| tae-miR1129 | 1.3e−005 | 1.88 | Up | 6 days drought | 114 | 172 |
| sbi-miR166e | 4.6e−003 | 1.53 | Down | 6 days drought | 127 | 185 |
| sbi-miR169c | 5.5e−003 | 1.57 | Down | 6 days drought | 117 | 175 |
| sbi-miR399a | 1.3e−002 | 2.19 | Down | 6 days drought | 128 | 186 |
| sbi-miR399b | 1.1e−002 | 2.19 | Down | 6 days drought | 90 | 148 |
| mtr-miR399d | 1.6e−002 | 2.33 | Down | 6 days drought | 122 | 180 |
| vvi-miR535a | 1.6e−002 | 1.89 | Down | 6 days drought | 131 | 189 |

Example 5

Method for Generating Transgenic Plants with Manipulated Expression of *Arabidopsis* microRNAs Synthetic DNA fragments were synthesized by Genscript® (GenScript USA Inc., Piscataway, N.J., USA) and cloned into the pUC57 vector. These clones contained, respectively, the hairpins of *Arabidopsis* microRNAs, flanked by 100-300 nucleotides of genomic DNA, as follows: ath-miR167a (SEQ ID NO: 193), ath-miR156a (SEQ ID NO: 191), ath-miR164a (SEQ ID NO: 192), and ath-miR169a (SEQ ID NO: 12). The DNA fragments were designed to contain BamHI and KpnI restriction enzyme recognition sites at the 5' and 3' ends, respectively. SEQ ID NOS: 191-193 contain within their hairpin sequence miRNAs which are identical to bna-miR167a (SEQ ID NO: 8), bna-miR156a (SEQ ID NO: 31) and osa-miR164a (SEQ ID NO: 110), respectively.

Each fragment was digested with BamHI and KpnI and ligated into the pORE E2 binary vector (Accession number: AY562535) previously digested with the same enzymes to drive the expression of the microRNA hairpins under the regulation of the hydroperoxide lyase (HPL) promoter. The HPL promoter is known to drive constitutive high-level expression of transgenes in dicot plants. It is known to be active in *Arabidopsis*, tobacco, cauliflower, soybean, alfalfa, peach, white spruce, wheat and grape. The resulting vectors were designated pORE156, pORE164, pORE167 and pORE169.

Each of the vectors was transformed by electroporation into *Agrobacterium tumefaciens* strain GV3101. Single colonies were grown and used to transform *Arabidopsis thaliana* plants, ecotype Colombia, using the floral dip method (Clough and Bent, The Plant Journal (1998) 16(6) 735-743). In this method, *Agrobacterium* was grown in appropriate growth medium and suspended in infiltration medium, into which plants were subsequently immersed. Seeds from the plants were collected and surface-sterilized, then plated on Petri dishes in *Arabidopsis* seed medium plus kanamycin and agarose. Transgenic plants became visible and were distinguished after about two weeks.

Transgenic plants are analyzed by PCR to validate integration of the transgene into the genome and by quantitative RT-PCR to validate over-expression of the relevant mature microRNA. Salinity and drought tolerance of the transgenic plants is compared to that of the wild type. Transgenic plants with relatively enhanced resistance to abiotic stress are identified.

Example 6

Method for Generating Transgenic Plants with Reduced microRNA Regulation

Target prediction enables manipulation of microRNA regulation by introducing silent mutations into the microRNA-binding site, leading to the expression of a microRNA-resistant target, thereby bypassing microRNA regulation. Alternatively, manipulation of microRNA regulation can be performed by microRNA over-expression. Both these strategies have been used in plants and have resulted in significant phenotype alterations.

Reducing microRNA regulation of target genes can potentially be achieved by two methods, either by expressing a microRNA-resistant gene or by expressing a target-mimic sequence.

Expressing a microRNA-Resistant Target

In this method, silent mutations are introduced in the microRNA binding site of the target gene so that the DNA and resulting RNA sequences are changed in a way that prevents microRNA binding, but the amino acid sequence of the protein is unchanged. For example, Arabidopsis miR-169a (5' CAGCCAAGGAUGACUUGCCGA 3', SEQ ID NO: 2) is predicted to target several CCAAT-binding transcription factors. The to predicted binding site for one of the targets (gene ID: 838335 NF-YA8) is as follows: 5'ACGGGAAGTCATCCTTGGCTA 3' (SEQ ID NO: 497).

A new sequence can be synthesized instead of the existing binding site, in which the DNA sequence is changed, but the translated amino acid sequence is retained, for example: 5' ATGGTAAAAGCAGTCTAGAGC 3' (SEQ ID NO: 498); the DNA sequence of the rest of the gene is left unchanged. Hybridization of the new sequence with miR-169a is impossible.

This new gene can be introduced into Arabidopsis plants and will express a functional gene, which is immune to miR-169a regulation and encodes a functional NF-YA8 protein.

Expressing a Target-Mimic Sequence

Figure 1:
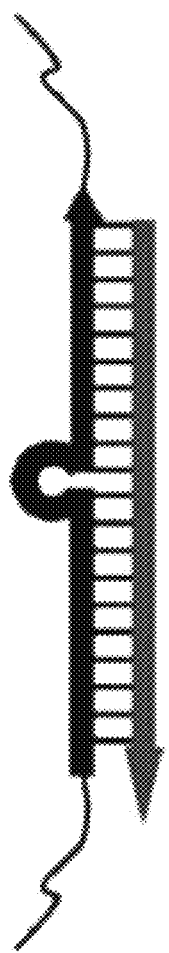

Plant microRNAs usually lead to cleavage of their targeted gene, with this cleavage typically occurring between bases 10 and 11 of the microRNA. This position is therefore especially sensitive to mismatches between the microRNA and the target. It was found that expressing a DNA sequence that could potentially be targeted by a microRNA, but contains two extra nucleotides between the two nucleotides that are predicted to hybridize with bases 10-11 of the microRNA (thus creating a bulge in that position), can inhibit the regulation of that microRNA on its native targets, as shown in FIG. 1.

This type of sequence is referred to as a "target-mimic" Inhibition of the microRNA regulation is presumed to occur through physically capturing the microRNA by the target-mimic sequence and titering-out the microRNA, thereby reducing its abundance. This method was previously used to reduce the amount and, consequentially, the regulation of microRNA 399 in Arabidopsis [Franco-Zorilla J M et al., Nature Genetics (2007) 39(8):1033-10371.

Predicted targets for regulating miRNA expression by sequence alteration in the transgenic plants of the present invention are shown for corn (Table 6) and sorghum (Table 7).

TABLE 6

Predicted miR targets in corn (Zea mays)

| Mir Family | Predicted target in Sorghum | SEQ ID NO: | ncbi accession #: | protein id | SEQ ID NO: |
|---|---|---|---|---|---|
| zma-169 | TC386981 | 195 | BT061088.1 | ACN25785 | 342 |
|  | TC398825 | 196 | NM_001176546.1 | NP_001170017 | 343 |
|  | TC391807 | 197 | NM_001155603.1 | NP_001149075 | 344 |
|  | TC396785 | 198 | BT038709.1 | ACF83714 | 345 |
|  | TC398710 | 199 | EU961865.1 |  |  |
|  | TC374958 | 200 | BT066403.1 | ACN33300 | 346 |
|  | TC414302 | 201 | BT036648.1 | ACF81653 | 347 |
|  | TC379185 | 202 | BT054250.1 | ACL52857 | 348 |
|  | TC402489 | 203 | BT062100.1 | ACN26797 | 349 |
|  | TC409629 | 204 | NM_001139400.1 | NP_001132872 | 350 |
| zma-167 | CF630597 | 205 | GQ905541.1 |  |  |
|  | TC384517 | 206 | HM004518.1 | ADG43137 | 351 |
|  | TC390155 | 207 | XM_002447260.1 | XP_002447305 | 352 |
|  | TC398618 | 208 | NM_001176880.1 | NP_001170351 | 353 |
|  | TC410716 | 209 | HM004518.1 | ADG43137 | 354 |
|  | CO439534 | 210 | NM_001175558.1 | NP_001169029 | 355 |
|  | TC400356 | 211 | AY110452.1 |  |  |
|  | TC402680 | 212 | AY108832.1 |  |  |
|  | TC414084 | 213 | NM_001196958.1 | NP_001183887 | 356 |
|  | TC433424 | 214 | AY110452.1 |  |  |
| ppt-miR894 | CF630597 | 215 |  |  |  |
|  | TC384517 | 216 | XM_002447260.1 | XP_002447305 | 357 |
|  | TC390155 | 217 | XM_002447260.1 | XP_002447305 | 358 |
|  | TC398618 | 218 | NM_001176880.1 | NP_001170351 | 359 |
|  | TC410716 | 219 | HM004518.1 | ADG43137 | 360 |
|  | CO439534 | 220 | NM_001175558.1 | NP_001169029 | 361 |
|  | TC400356 | 221 | AY110452.1 |  |  |
|  | TC402680 | 222 | AY108832.1 |  |  |
|  | TC414084 | 223 | NM_001196958.1 | NP_001183887 | 362 |
|  | TC433424 | 224 | AY110452.1 |  |  |
| zma-164 | TC372777 | 225 | AJ833967.1 | CAH56058 | 363 |
|  | TC372793 | 226 | AJ833966.1 | CAH56057 | 364 |
|  | TC393990 | 227 | NM_001175536.1 | NP_001169007 | 365 |
|  | TC375804 | 228 | NM_001196213.1 | NP_001183142 | 366 |
|  | TC402142 | 229 | NM_001147702.1 | NP_001141174 | 367 |
|  | CO452388 | 230 | EU971666.1 | ACG43784 | 368 |
|  | TC385354 | 231 | NM_001136787.1 | NP_001130259 | 369 |
|  | TC422132 | 232 | NM_001175843.1 | NP_001169314 | 370 |
|  | TC403112 | 233 | NM_001174985.1 | NP_001168456 | 371 |
|  | DY689161 | 234 | NM_001153167.1 | NP_001146639 | 372 |
|  | TC384685 | 235 | BT065898.1 | ACN31774 | 373 |

TABLE 6-continued

Predicted miR targets in corn (Zea mays)

| Mir Family | Predicted target in Sorghum | SEQ ID NO: | ncbi accession #: | protein id | SEQ ID NO: |
|---|---|---|---|---|---|
| zma-156 | TC374118 | 236 | BT041777.2 | ACF86782 | 374 |
| | TC375695 | 237 | EU965000.1 | ACG37118 | 375 |
| | TC378352 | 238 | XM_002456814.1 | XP_002456859 | 376 |
| | TC383848 | 239 | EU965000.1 | ACG37118 | 377 |
| | TC384479 | 240 | BT054654.1 | ACL53261 | 378 |
| | TC386709 | 241 | AJ011618.1 | CAB56631 | 379 |
| | TC387392 | 242 | NM_001152255.1 | NP_001145727 | 380 |
| | TC391022 | 243 | BT084089.1 | ACR34442 | 381 |
| | TC401092 | 244 | NM_001143577.1 | NP_001137049 | 382 |
| ath-854a | TC401234 | 245 | NM_001157179.1 | NP_001150651 | 383 |
| | DY686870 | 246 | NM_001174356 | NP_001167827 | 384 |
| | TC393284 | 247 | BT066855 | ACN33752 | 385 |
| | TC411429 | 248 | BT066855 | GI:224029354 | 386 |
| | DY690365 | 249 | NM_001148543 | GeneID:100274170 | 387 |
| | DY540023 | 250 | BT066855 | GI:224029354 | 388 |
| zma-408 | TC402312 | 251 | EU960320.1 | ACG32438 | 389 |
| | TC391154 | 252 | BT034048.1 | ACF79053 | 390 |
| | TC427342 | 253 | EU968152.1 | ACG40270 | 391 |
| | TC389262 | 254 | EU968133.1 | ACG40251 | 392 |
| | CF629729 | 255 | NM_001157426.1 | NP_001150898 | 393 |
| ppt-160 | TC381634 | 256 | BT066347.1 | ACN33244 | 394 |
| | TC390948 | 257 | NM_001177066.2 | NP_001170537 | 395 |
| | TC418657 | 258 | HM004534.1 | ADG43153 | 396 |
| | TC432471 | 259 | NM_001165660.1 | NP_001159132 | 397 |
| | TC421073 | 260 | HM004523.1 | ADG43142 | 398 |
| | TC415261 | 261 | NM_001138464.1 | NP_001131936 | 399 |
| | TC448806 | 262 | BT037289.1 | ACF82294 | 400 |
| | EE019332 | 263 | NM_001138464.1 | NP_001131936 | 401 |
| osa-390 | TC391640 | 264 | XM_002446809 | XP_002446854 | 402 |
| | TC374339 | 265 | BT065284 | ACN31160 | 403 |
| | TC389787 | 266 | BT084950 | ACR35303 | 404 |
| | TC445821 | 267 | EU975178 | ACG47296 | 405 |
| | AW400087 | 268 | EU971344 | ACG43462 | 406 |
| zma-172 | TC372773 | 269 | NM_001112420.1 | NP_001105890 | 407 |
| | TC398940 | 270 | NM_001111434.1 | NP_001104904 | 408 |
| | TC402407 | 271 | EF659468.1 | ABR19871 | 409 |
| | TC436312 | 272 | BT088249.1 | ACR38602 | 410 |
| | TC391722 | 273 | NM_001174720.1 | NP_001168191 | 411 |
| | TC408576 | 274 | NM_001153337.1 | NP_001146809 | 412 |
| | CO526464 | 275 | AC165172.2 | | |
| | DY541073 | 276 | BT063595.1 | ACN28292 | 413 |
| zma-171 | TC402076 | 277 | NM_001138495.1 | | |
| | TC409673 | 278 | BT018211.1 | | |
| | TC378220 | 279 | NM_001174946.1 | NP_001168417 | 414 |
| | TC380985 | 280 | NM_001147253.1 | NP_001140725 | 415 |
| | TC385333 | 281 | NM_001152284.1 | NP_001145756 | 416 |
| | TC388259 | 282 | BT069447.1 | ACN36344 | 417 |
| smo-1091 | TC373124 | 283 | BT064902.1 | ACN30778 | 418 |
| | TC420039 | 284 | BT086539.1 | ACR36892 | 419 |
| zma-399d | TC372604 | 285 | NM_001112347.1 | NP_001105817 | 420 |
| | TC384393 | 286 | BT086308.1 | ACR36661 | 421 |
| | TC405480 | 287 | NM_001112347.1 | NP_001105817 | 422 |
| | EE168670 | 288 | NM_001112347.1 | NP_001105817 | 423 |
| osa-530-3p | TC394057 | 289 | BT054711.1 | ACL53318 | 424 |
| | TC399070 | 290 | AY111547.1 | | |
| | EE681052 | 291 | NM_001155648.1 | NP_001149120 | 425 |
| | TC423023 | 292 | BT041995.2 | ACF87000 | 426 |
| | TC423251 | 293 | EU955378.1 | ACG27496 | 427 |
| | CB833661 | 294 | BT041995.2 | ACF87000 | 428 |
| | DRV86428 | 295 | BT066466.1 | ACN33363 | 429 |
| ppt-477a-3p | CF048906 | 296 | NM_001148796 | NP_001142268 | 430 |
| | TC380158 | 297 | BT038098 | ACF83103 | 431 |
| | TC373894 | 298 | BT054486 | ACL53093 | 432 |
| | TC417766 | 299 | BT054486 | ACL53093 | 433 |
| | EE042910 | 300 | BT040656 | ACF85661 | 434 |
| | TC382335 | 301 | NM_001147977 | NP_001141449 | 435 |
| zma-395 | TC391887 | 302 | BT063912.1 | ACN28609 | 436 |
| | TC391300 | 303 | NM_001111407.1 | NP_001104877 | 437 |
| | CO462284 | 304 | BT067126.1 | ACN34023 | 438 |
| ath855 | TC373849 | 305 | NM_001157122.1 | NP_001150594 | 439 |
| | TC375345 | 306 | BT035131.1 | ACF80136 | 440 |
| | CO445522 | 307 | BT035131.1 | ACF80136 | 441 |

TABLE 6-continued

Predicted miR targets in corn (Zea mays)

| Mir Family | Predicted target in Sorghum | SEQ ID NO: | ncbi accession #: | protein id | SEQ ID NO: |
|---|---|---|---|---|---|
| ppt-1039-3p | BM339650 | 308 | EU943793.1 | | |
| zma-168 | TC374776 | 309 | NM_001176734.1 | NP_001170205 | 442 |
| | TC413096 | 310 | XM_002440366.1 | XP_002440411 | 443 |
| | CO459887 | 311 | XM_002440366.1 | XP_002440411 | 444 |
| | EE285427 | 312 | NM_001175810.1 | NP_001169281 | 445 |
| ppt-529g | TC372784 | 313 | AY883559.2 | AAX83872 | 446 |
| | TC429571 | 314 | AY883560.1 | AAX83873 | 447 |
| | TC432052 | 315 | AY883559.2 | AAX83872 | 448 |
| | TC401092 | 316 | NM_001143577.1 | NP_001137049 | 449 |
| | TC378352 | 317 | XM_002456814.1 | XP_002456859 | 450 |
| | TC441933 | 318 | BT064694.1 | ACN30570 | 451 |
| | TC397772 | 319 | NM_001152261.1 | NP_001145733 | 452 |
| | TC374506 | 320 | NM_001139359.2 | NP_001132831 | 453 |
| osa-528 | TC378699 | 321 | NM_001152326 | NP_001145798 | 454 |
| | TC372588 | 322 | NM_001112445 | NP_001105915 | 455 |
| | TC372613 | 323 | NM_001112451 | NP_001105921 | 456 |
| ppt-896 | TC406311 | 324 | EU959481.1 | ACG31599 | 457 |
| zma-159 | BM338067 | 325 | ACG30664.1 | ACG30664 | 458 |
| | TC383580 | 326 | NM_001137160.1 | NP_001130632 | 459 |
| | TC378278 | 327 | NM_001148578.1 | NP_001142050 | 460 |
| | TC375562 | 328 | NM_001148578 | NP_001142050 | 461 |
| | TC398538 | 329 | NM_001148578.1 | NP_001142050 | 462 |
| | TC429458 | 330 | NM_001148578.1 | NP_001142050 | 463 |
| | CO439496 | 331 | NM_001148578.1 | NP_001142050 | 464 |
| tae-1129 | TC377131 | 332 | NM_001148336 | NP_001141808 | 465 |
| ppt-1026a | XM_001761787.1 | 333 | XM_001761787.1 | XP_001761839 | 466 |
| ppt-901 | TC404127 | 334 | AY108169 | | |
| zma-166 | TC372571 | 335 | BT066287.1 | ACN32163 | 467 |
| | TC374219 | 336 | NM_001112524.1 | NP_001105994 | 468 |
| | TC383262 | 337 | NM_001148922.1 | NP_001142394 | 469 |
| | DV510458 | 338 | NM_001152743.1 | NP_001146215 | 470 |
| | EE185687 | 339 | NM_001152743.1 | NP_001146215 | 471 |
| osa-535 | TC395045 | 340 | NM_001148293.1 | NP_001141765 | 472 |
| | DV028665 | 341 | BT065661.1 | ACN31537 | 473 |

TABLE 7

Predicted miR targets in sorghum

| Mir Family | Predicted target in Sorghum | SEQ ID NO: | ncbi accession #: | protein id | SEQ ID NO: |
|---|---|---|---|---|---|
| ppt-395 | TC115368 | 474 | XM_002448709 | XP_002448754 | 486 |
| | TC128625 | 475 | EU962499 | | |
| | 5279979 | 476 | XM_002461779 | XP_002461824 | 487 |
| abi-397 | TC129073 | 477 | BT064158 | ACN28855 | 488 |
| | CF429403 | 478 | XM_002458701.1 | XP_002458746 | 489 |
| | 5283185 | 479 | XM_002458702.1 | XP_002458747 | 490 |
| | 5279496 | 480 | XM_002465904.1 | XP_002465949 | 491 |
| | 5289814 | 481 | XM_002439871.1 | XP_002439916 | 492 |
| | 5259332 | 482 | XM_002465440.1 | XP_002465485 | 493 |
| smo-1091 | TC121467 | 483 | XM_002465662.1 | XP_002465707 | 494 |
| tae-1134 | 5279991 | 484 | XM_002459659.1 | XP_002459704 | 495 |
| | CF488307 | 485 | XM_002459659.1 | XP_002459704 | 496 |

Example 7 miR-156a and miR-169a Transgenic Plants Comprising Enhanced Drought Tolerance Native hairpins of miRs ath-156a and ath-169a were synthesized by Genscript (order no. 72356) with BamHI and KpnI restriction sites at the beginning and the end of the gene, respectively. The 312 by fragments were excised and inserted into pORE-E2 plasmid using BamHI and KpnI restriction enzymes in sequential digest (as described in Example 5, above). RBC (Real Biotech Corporation) E. coli DH5α competent cells were transformed with these ligations. Colony PCR on kanamycin resistant colonies was performed using miR specific primer and M13rev universal primer (present in pORE-E2). pORE-E2-156a colony #4 and pORE-E2-169a colony #1 were chosen for further work after plasmid purification using kit and sequencing of the plasmid to verify correct sequence.

Home-made competent *Agrobacterium tumefaciens* were transformed with the plasmids. Bacteria were shaken in 28° C. for 2 hours for regeneration, and then plated on LB+kanamycin 50 µg/ml for selection of resistant colonies for 48 hours. Colonies were then subjected to PCR for verification of plasmid integration using miR specific rev primer and pORE-E2 specific primer. Colony #1 for each plasmid was chosen for plants transformation.

*Arabidopsis thaliana* seeds were sown in pots, and then incubated in 4° C. for 2 days. Trays were then moved into growth rooms (20-22° C., long day—16 hours light, 8 hours dark). After 3 weeks plants were cut to enable growth of many branches. After a week, the plants were taken for transformation. *Agrobacteria* carrying the plasmids were grown for 3 days prior to transformation. On transformation day, bacteria were re-checked for correct plasmid presence by PCR. *Agrobacteria* were precipitated and then re-suspended in infiltration medium (10 mM MgCl2, 5% Sucrose, 0.044 µM BAP and 0.03% Tween 20) in deep bowls. The well watered plants were flipped over into the liquid until all flowers were sunken. After 3 minutes, pots were taken out and were laid on both sides on filtered paper to absorb liquids. After 24 hours, pots were straightened and watered. Plants were left to develop seeds in the growth rooms. Seeds were collected after a few weeks, and then were germinated on GM agar plates containing kanamycin 50 µg/ml for selection of resistant plants. Resistant seedling were transferred to pots and grown for two more generation. Homozygous plants of each plasmid were chosen for further characterization of expression of miR156a and miR169a (156-1-1 and 169-3-28, respectively).

As is illustrated in FIGS. 2A-B, 3A-B, 4, 5A-C and 6A-B 156-1-1, 169-3-28 transgenic plants and wild-type plants were grown for 3 weeks under the same conditions (as described above). Plants of each line were then divided into two separate trays; one tray was watered normally and the other was deprived of water for 10 days. After 10 days, the dehydrated trays were watered again in two day intervals.

As shown in FIGS. 2A and 3A, control watered trays of all three lines displayed similar characteristics: the wild-type and the transgenic plants all have similar sizes, number of branches and flowers. However, as is illustrated in FIGS. 2B, 3B, 4, 5A-C and 6A-B, the wild-type plants could not recover from the de-hydration, and all the wild-type plants died, in sharp contrast, most of the transgenic plants recovered and displayed characteristics similar to the hydrated control plants.

Although the invention has been described in conjunction with specific embodiments thereof, it is evident that many alternatives, modifications and variations to will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (498 sequences)

SEQ ID NO: 1 - RNA, 21 nt, Oryza sativa
uagccaaggaugacuugccgg

SEQ ID NO: 2 - RNA, 21 nt, Arabidopsis thaliana
cagccaaggaugacuugccga

SEQ ID NO: 3 - RNA, 21 nt, Populus trichocarpa
aagccaaggaugacuugccug

SEQ ID NO: 4 - RNA, 21 nt, Brassica napus
uagccaaggaugacuugccua

SEQ ID NO: 5 - RNA, 21 nt, Populus trichocarpa
uagccaaggaugacuugccca

SEQ ID NO: 6 - RNA, 21 nt, Arabidopsis thaliana
ugagccaaggaugacuugccg

SEQ ID NO: 7 - RNA, 21 nt, Arabidopsis thaliana
uaagcugccagcaugaucuug

SEQ ID NO: 8 - RNA, 22 nt, Brassica napus
ugaagcugccagcaugaucuaa

SEQ ID NO: 9 - RNA, 21 nt, Physcomitrella patens
ggaagcugccagcaugauccu

SEQ ID NO: 10 - RNA, 21 nt, Populus trichocarpa
ugaagcugccagcaugaucuu

SEQ ID NO: 11 - RNA, 132 nt, Oryza sativa
gcugguuguguagccaaggaugacuugccggccugguuuguguucaucagcaauccagcauaugcuguauugccgugugugaucgaucgaugcauggaccggcaaguuauuuucuuuggcuacauuacaacc

SEQ ID NO: 12 - RNA, 226 nt, Arabidopsis thaliana
gugacgaaaguagugugcagccaaggaugacuugccgauuuaaaugaucuuucuuuauacucuauuaagacaauuuaguuucaaacuuuuuuuuuuuuuuuuuuuugaaggauucaggaagaaauuaggauauauuauuccguauaaaauacaagauauauaaaaccaaaaagaaaaaguaacaugaucggcaaguuguccuuggcuacacguuacuuugugucgc

SEQ ID NO: 13 - RNA, 104 nt, Populus trichocarpa
ccuugcguggaagccaaggaugacuugccugagaauuuuaggaagguuucuauaugaaagcuuuuuauuaguuuugcaggaagucaaccuuggcuuuccuauag

SEQ ID NO: 14 - RNA, 176 nt, Brassica napus
agaugaauagaagaaucauauuugguagccaaggaugacuugccuauuucuugagaguaaaaugggcauggugucauguuaaaaguuacuguagguaguuucaauuugaccauuuuccuuacaaaugauauuaggcagucuccuuggcuauccuuauauguucuucucucucaucu

SEQ ID NO: 15 - RNA, 110 nt, Populus trichocarpa
cguguuugguagccaaggaugacuugcccacuccauugaaagaguuuuucaagcauaugguaguguagaacuuuucuuugguucugggcagucaucuuggcuaugcugac

SEQ ID NO: 16 - RNA, 154 nt, Arabidopsis thaliana
guaucauagagucuugcauggaaaaauuaaagaaugagauugagccaaggaugacuugccgauguuaucaacaaaucuuaacugauuuugguguccggcaaguugaccuuggcucuguuuccuucuuuucuuuucaaugucaaacucuagauau

SEQ ID NO: 17 - RNA, 160 nt, Arabidopsis thaliana
ccaguagcaguuaagcugccagcaugaucuugucuuccucucuuagguuucauauauaguuaauaaauauuuuauauauuucuuguucuuacaagauuauaugaucauagcuuagagagagagagagacuaggucaugcugguaguuucaccugcuaaug

SEQ ID NO: 18 - RNA, 132 nt, Brassica napus
gguguacaggcaucugaugaagcugccagcaugaucuaauuaacuuucuuucucuguugauuuuaugacaauggaaaagagaugagugucgauuagaucauguucgcaguuucacccauugacugucgcacc

SEQ ID NO: 19 - RNA, 82 nt, Physcomitrella patens
accaaaaguuggaagcugccagcaugauccuuuaacuuuucuagagggaaagaucagaucaucuggcugcuuucauccuguu

SEQ ID NO: 20 - RNA, 87 nt, Physcomitrella patens
cucuaucaguugaagcugccagcaugaucuuagccuuccuccuuuguugaggaaagaaacagaucauguggcaguuucaccuguugu

SEQ ID NO: 21 - RNA, 20 nt, Physcomitrella patens
cguuucacgucggguucacc

SEQ ID NO: 22 - RNA, 21 nt, Oryza sativa
uggagaagcagggcacgugag

SEQ ID NO: 23 - RNA, 22 nt, Brassica napus
uagccaaggaugacuugccugc

SEQ ID NO: 24 - RNA, 21 nt, Vitis vinifera
gagccaaggaugacuugccgg

SEQ ID NO: 25 - RNA, 21 nt, Populus trichocarpa
uagccaaggacgacuugccug

SEQ ID NO: 26 - RNA, 220 nt, Physcomitrella patens
cauaauucaaauaauccaaaaaaaauaaaccaaauaccuuccaccucaagcguuucacgucggguucaccaaauauguuguauuaugugaaguuuugauugagaaugcaccgagcacuuggcuauggaagguaaaagaaaauugcaacaaaaaguccuaacaauccaauaggauuauagaaaauuuauaauuaaacguuaacaaucauaaucaaacaaua

SEQ ID NO: 27 - RNA, 132 nt, Oryza sativa
uugugcaggguggagaagcagggcacgugagcggccauccaguguagcuucgcugcgcguccauggcggcgaacgcgcgugaucuggaguuuggauggucguucauguguccgucuucuccaccgagcacug

SEQ ID NO: 28 - RNA, 168 nt, Brassica napus
gagaaacggugacaugaagaaugagaaguugugugguagccaaggaugacuugccugcgucuuuaacaccauaucaaagacuuuaucgauagucucugaguugguuaggcuguaggcagucuccuuggcuauucagacacuccucuuucuccucauuucacauuucuc

SEQ ID NO: 29 - RNA, 102 nt, Vitis vinifera
agaguggaagugagccaaggaugacuugccggcagcugcagcaaggcauuaagguuuaacuggccauaacuggcaagcauccgaggcucuguuucacccucu

SEQ ID NO: 30 - RNA, 115 nt, Populus trichocarpa
ucuuguuaguuagccaaggacgacuugccuguuccuagcaauuugggauuugcccuggacuaagaggcaggacccucauuccggguuucaggcagucuccuuggcuagguugaca

SEQ ID NO: 31 - RNA, 21 nt, Brassica napus
ugacagaagagagugagcaca

SEQ ID NO: 32 - RNA, 20 nt, Arabidopsis thaliana
cgacagaagagagugagcac

SEQ ID NO: 33 - RNA, 21 nt, Oryza sativa
cgacagaagagagugagcaua

SEQ ID NO: 34 - RNA, 21 nt, Arabidopsis thaliana
gaugaggauagggaggaggag

SEQ ID NO: 35 - RNA, 21 nt, Physcomitrella patens
ggggagacgggcucaaggauc

SEQ ID NO: 36 - RNA, 20 nt, Zea mays
ugacagaagagagcgagcac

SEQ ID NO: 37 - RNA, 20 nt, Vitis vinifera
ugacagaggagagugagcac

SEQ ID NO: 38 - RNA, 21 nt, Sorghum bicolor
ugacagaagagagagagcaca

SEQ ID NO: 39 - RNA, 22 nt, Arabidopsis thaliana
ugaagcugccagcaugaucugg

SEQ ID NO: 40 - RNA, 21 nt, Populus trichocarpa
ugaagcugccaacaugaucug

SEQ ID NO: 41 - RNA, 21 nt, Sorghum bicolor
ucgcuuggugcagaucgggac

SEQ ID NO: 42 - RNA, 21 nt, Glycine max
ucgcuuggugcaggucgggaa

SEQ ID NO: 43 - RNA, 21 nt, Saccharum officinarum
cugcacugccucuucccuggc

SEQ ID NO: 44 - RNA, 21 nt, Arabidopsis thaliana
augcacugccucuucccuggc

SEQ ID NO: 45 - RNA, 21 nt, Physcomitrella patens
cgccuggcucccuguaugcca

SEQ ID NO: 46 - RNA, 21 nt, Physcomitrella patens
cgccuggcucccugcaugcca

SEQ ID NO: 47 - RNA, 21 nt, Oryza sativa
aagcucaggagggauagcgcc

SEQ ID NO: 48 - RNA, 21 nt, Physcomitrella patens
gagcucaggagggauagcgcc

SEQ ID NO: 49 - RNA, 82 nt, Brassica napus
ugacagaagagagugagcacacaaaaguaaucugcauauacugcauuugcuucucuugcgugcucacugcucuuucugucag

SEQ ID NO: 50 - RNA, 103 nt, Arabidopsis thaliana
auaacgaaggcgacagaagagagugagcacacauggcucuuuuucuagcaugcucaugcucgaaagcucugcgugcuuacucucuucuugucuccugcucucu

SEQ ID NO: 51 - RNA, 156 nt, Oryza sativa
gcuagggagccgacagaagagagugagcauauauaguucuuuccuugcauauguggucauauguguguugacugaagagauacauauauauagagagagagaguucaugugcuugaagcuauaugugcucacuucucuuucugucagcaaauuauc

SEQ ID NO: 52 - RNA, 221 nt, Arabidopsis thaliana
cggaugaggauagggaggaggaguaugauacgagcauguaucauuucagugagcacguaccuccagcgcgggagagcaagagcuugagugaagcucauagaaacaacaguaaguugcagagguggugcaagaaacaagauaggcuacuuaucaagugcuucaaagccaucacguuucugacggacaagauaagcugcuucucuucuacuacagcuauuccg

SEQ ID NO: 53 - RNA, 130 nt, Physcomitrella patens
aggagcuuauugugucagccacauuagggucuuugggucuuucucuccugaaaauguuaagagcuugagcgcuuaauuuuucaggggagacgggcucaaggaucuugaagugguugccuggggaugauaa

SEQ ID NO: 54 - RNA, 123 nt, Zea mays
ggcuuaggccccgaagagauugacagaagagagcgagcaccuggcgcggcgaccggcauggaacgcaugccguccccgccgcgugcucgcuucucuuucugucagccucucccucguccugag

SEQ ID NO: 55 - RNA, 108 nt, Vitis vinifera
guaugguaggugacagaggagagugagcacucaugguucuuuucuugcaugaaguuucuaugcuugaagcucugugugcuuacucccuaucugucaccccucaagcau

SEQ ID NO: 56 - RNA, 125 nt, Sorghum bicolor
uggaccucuggagugagugaugacagaagagagagagcacaacccagcaccagcgaggagaagccucgcuucugcgagggccgugugcucucugcucucacugucaucgccgacaggccacccaa

SEQ ID NO: 57 - RNA, 377 nt, Arabidopsis thaliana
uguugguuuuuagaagcugaagcugccagcaugaucugguaaucgcuacauacgacauacacacaucacuaaacuucuuuauaauuuaugcacacacauacagcucuuaauggccacaacucaaaguuauaauuagugcaugaucucuaguuauuugacugcuuuuaauauauguuuauggauucacgcauguguguguauguacauaauuuacaugcaugcacuuuguguaugguacacaucaauuugaacccguucaaaauucuguuuuuauuaguauauauauagauguauguggugugugugucaguguguguguguguuuauagauaguaguacuaggucauccugcagcuucagucacuaaaucaccaaca

SEQ ID NO: 58 - RNA, 91 nt, Populus trichocarpa
cgcuauuaguugaagcugccaacaugaucugagcuuuccuuaauuuuccuauacaggaaagacuagaucauguggcaguuucaccuauuga

SEQ ID NO: 59 - RNA, 106 nt, Sorghum bicolor
gccgccgcgccgccucgggcucgcuuggugcagaucgggaccugccgccgugcucggacgggacagaucccgccuugcaccaagugaauccgagccggagcagccg

SEQ ID NO: 60 - RNA, 127 nt, Glycine max
ggcacgaggcggucucuaauucgcuuggugcaggucgggaaccgguuuucgcgcggaauggaggagcggucgccggcgccgaauuggaucccgccuugcaucaacugaaucggaggccgcggugaac

SEQ ID NO: 61 - RNA, 283 nt, Saccharum officinarum
agaagauggguaugguuggagacagggaugaggcagagcaugggaugaggccaucaacaaaauuuccaauuucuguccuccgcuaggccgcuacugcauuucuguuugcuugcucacaaaacggagggauuugugagaguuaucaggcagaaagaacaaagaaggugccucccuggugaaguggugauggccugaccugagacggcugagagcucagcugguguccuguuguugcuuccuccccugcacugccucuucccuggcuccccaccguugcccuugc

SEQ ID NO: 62 - RNA, 218 nt, Arabidopsis thaliana
aagguuagauugguauugcaaugaaagaagacaaagcgguaaugagagagagacagggaacaagcagagcauggauugaguuuacuaaaacauuaaacgacucuguuuugucucuacccaugcacugccucuucccuggcucccucuuuuuuucucuauauuucucucucuccuuucauuucacagcuuucaauggaauuuuauugcuacugcuaacg

SEQ ID NO: 63 - RNA, 103 nt, Physcomitrella patens
augcuagauccgccuggcucccuguaugccaacugcgagccuugcuaaauauuuguuugccuugauucauagcuggcguucagggagucaagcagaccuugcg

SEQ ID NO: 64 - RNA, 100 nt, Physcomitrella patens
auauuggauccgccuggcucccugcaugccacuugcgaaucuugccaaacguuuugucgggguucauggcuggcguguggggggucagacaggccauaca

SEQ ID NO: 65 - RNA, 91 nt, Oryza sativa
gguauggaacaauccuugaagcucaggagggauagcgccucgaaaucaaacuaggcgcuaucuauccugagcuccaugguuuguucuuacc

SEQ ID NO: 66 - RNA, 135 nt, Physcomitrella patens
gguauaauuacagagcucaggagggauagcgcccaucucagucuuuuuuagcauccaauugaaaugguuaacauuccuuuggauagcuagacggcgaagcauggcgcuguccauucugagcauugcauuuguacc

SEQ ID NO: 67 - RNA, 115 nt, Sorghum bicolor
ucggagccgacucucugcaggugcagcagcaucaagguucgccagcagcaagcgaucgaucgaggcgugugugugugaaucuugaugaugcugcaccagcaaugagccggccggc

SEQ ID NO: 68 - RNA, 135 nt, Selaginella moellendorffii
cgagcgagagcgauauuggcucugcucaaucgcaugacgcugcugcaucgcacgaaaaauuugcgaugggaauggaucgauggagucgcagcagaggcaugagauugagccgugccaauaucacugguguuuuuc

SEQ ID NO: 69 - RNA, 103 nt, Selaginella moellendorffii
ugugucugugauauugacaaggcucaaucaggcugcaaugcuacucgagcuaauuagugaugcugccagcuugagccgugccaauaucacauagauagcuagc

SEQ ID NO: 70 - RNA, 132 nt, Sorghum bicolor
auggccgccgcgcgcgacgggguauuggcgcgguucaauucgagagcucgagcccuagacuagacgccagggagagagggggcucugcucucugauugagccgugccaauaucacgucccgcuugaauggcu

SEQ ID NO: 71 - RNA, 118 nt, Zea mays
ggggaaucgaaaaccuacgggauauuggugcgguucaaucagaaagcuugcgcuccaaagcccaggggcuccacucuuugacugagccgugccaauaucacguccucgcuuugcuugc

SEQ ID NO: 72 - RNA, 155 nt, Zea mays
uugguuguuggcugagagagugcgauguuggcauggcucaaucaacucgccggccgcggguggcuuauagcuuaauucugcgcauucgaucgaggugcgggcgcaguguuuaauugauugagccgugccaauaucacaaccuucucuagccuaua

SEQ ID NO: 73 - RNA, 21 nt, Sorghum bicolor
ugaaucuugaugaugcugcac

SEQ ID NO: 74 - RNA, 21 nt, Selaginella moellendorffii
uugagccgugccaauaucacu

SEQ ID NO: 75 - RNA, 21 nt, Selaginella moellendorffii
ugagccgugccaauaucacau

SEQ ID NO: 76 - RNA, 21 nt, Sorghum bicolor
ugauugagccgugccaauauc

SEQ ID NO: 77 - RNA, 21 nt, Zea mays
ugacugagccgugccaauauc

SEQ ID NO: 78 - RNA, 21 nt, Zea mays
uugagccgugccaauaucaca

SEQ ID NO: 79 - RNA, 21 nt, Selaginella moellendorffii
uugacagaagaaagagagcac

SEQ ID NO: 80 - RNA, 21 nt, Selaginella moellendorffii
uugacagaagacagggagcac

SEQ ID NO: 81 - RNA, 20 nt, Physcomitrella patens
cugaagcguuugggggaagg

SEQ ID NO: 82 - RNA, 21 nt, Selaginella moellendorffii
cggcagugagggaggauuugc

SEQ ID NO: 83 - RNA, 23 nt, Triticum aestivum
cacuacauuauggaauggaggga

SEQ ID NO: 84 - RNA, 24 nt, Triticum aestivum
caacaacaacaagaagaagaagau

SEQ ID NO: 85 - RNA, 21 nt, Vitis vinifera
uugagccgugccaauaucaug

SEQ ID NO: 86 - RNA, 21 nt, Vitis vinifera
uugagccgugccaauaucauc

SEQ ID NO: 87 - RNA, 21 nt, Glycine max
agaaucuugaugaugcugcau

SEQ ID NO: 88 - RNA, 21 nt, Arabidopsis thaliana
agaaucuugaugaugcugcag

SEQ ID NO: 89 - RNA, 21 nt, Zea mays
ggaaucuugaugaugcugcau

SEQ ID NO: 90 - RNA, 21 nt, Sorghum bicolor
ugccaaaggagagcugcccug

SEQ ID NO: 91 - RNA, 21 nt, Oryza sativa
aggugcagaggcagaugcaac

SEQ ID NO: 92 - RNA, 21 nt, Physcomitrella patens
cgaagagagagagcacagccc

SEQ ID NO: 93 - RNA, 21 nt, Physcomitrella patens
agaagagagagagcacagccc

SEQ ID NO: 94 - RNA, 21 nt, Physcomitrella patens
agaagagagagaguacagccc

SEQ ID NO: 95 - RNA, 21 nt, Physcomitrella patens
cgaagagagagagcacagucc

SEQ ID NO: 96 - RNA, 21 nt, Oryza sativa
cagccaaggaugacuugccga

SEQ ID NO: 97 - RNA, 21 nt, Sorghum bicolor
cagccaaggaugacuugccgg

SEQ ID NO: 98 - RNA, 21 nt, Brassica napus
ugagccaaagaugacuugccg

SEQ ID NO: 99 - RNA, 21 nt, Arabidopsis thaliana
cugaaguguuugggggaacuc

SEQ ID NO: 100 - RNA, 22 nt, Brassica napus
ucauugagugcagcguugaugu

SEQ ID NO: 101 - RNA, 21 nt, Populus trichocarpa
ccauugagugcagcguugaug

SEQ ID NO: 102 - RNA, 22 nt, Selaginella moellendorffii
ugcacugccucuucccuggcug

SEQ ID NO: 103 - RNA, 21 nt, Oryza sativa
uggaaggggcaugcagaggag

SEQ ID NO: 104 - RNA, 21 nt, Arabidopsis thaliana
uugagccgugccaauaucacg

SEQ ID NO: 105 - RNA, 25 nt, Physcomitrella patens
gucaauuuggccgagugguuaaggc

SEQ ID NO: 106 - RNA, 21 nt, Pinus taeda
cuuggauugaagggagcuccc

SEQ ID NO: 107 - RNA, 21 nt, Saccharum officinarum
cuuggauugaagggagcuccu

SEQ ID NO: 108 - RNA, 21 nt, Oryza sativa
auuggauugaagggagcucca

SEQ ID NO: 109 - RNA, 21 nt, Oryza sativa
auuggauugaagggagcuccg

SEQ ID NO: 110 - RNA, 21 nt, Oryza sativa
uggagaagcagggcacgugca

SEQ ID NO: 111 - RNA, 21 nt, Sorghum bicolor
uggagaagcagggcacgugcu

SEQ ID NO: 112 - RNA, 21 nt, Oryza sativa
uggagaagcaggguacgugca

SEQ ID NO: 113 - RNA, 21 nt, Populus trichocarpa
uggagaagcagggcacaugcu

SEQ ID NO: 114 - RNA, 24 nt, Triticum aestivum
cagcgagccagcggagaccggcag

SEQ ID NO: 115 - RNA, 20 nt, Saccharum officinarum
ucgcuugggcagaucgggac

SEQ ID NO: 116 - RNA, 21 nt, Oryza sativa
aggcuuggugcagcucgggaa

SEQ ID NO: 117 - RNA, 21 nt, Sorghum bicolor
uagccaaggaugacuugccua

SEQ ID NO: 118 - RNA, 21 nt, Sorghum bicolor
uagccaagaaugacuugccua

SEQ ID NO: 119 - RNA, 21 nt, Populus trichocarpa
uagccaaggaugacuugcucg

SEQ ID NO: 120 - RNA, 21 nt, Sorghum bicolor
gugagccgaaccaauaucacu

SEQ ID NO: 121 - RNA, 21 nt, Sorghum bicolor
augagccgaaccaauaucacu

SEQ ID NO: 122 - RNA, 21 nt, Medicago truncatula
ugccaaaggagagcugcccua

SEQ ID NO: 123 - RNA, 21 nt, Physcomitrella patens
agaagccuuugugggagagga

SEQ ID NO: 124 - RNA, 22 nt, Arabidopsis thaliana
agcaaaagcuaaggaaaaggaa

SEQ ID NO: 125 - RNA, 21 nt, Physcomitrella patens
ugagaaagacuugagaggaca

SEQ ID NO: 126 - RNA, 21 nt, Physcomitrella patens
gguaaaguggcggcuagguua

SEQ ID NO: 127 - RNA, 21 nt, Sorghum bicolor
ucggaccaggcuucaaucccu

SEQ ID NO: 128 - RNA, 21 nt, Sorghum bicolor
ugccaaaggagaauugcccug

SEQ ID NO: 129 - RNA, 20 nt, Populus trichocarpa
ugacagaagagagggagcac

SEQ ID NO: 130 - RNA, 20 nt, Oryza sativa
gagaagagagagaguacagc

SEQ ID NO: 131 - RNA, 22 nt, Vitis vinifera
ugacaacgagagagagcacgcu

SEQ ID NO: 132 - RNA, 21 nt, Populus trichocarpa
gagccaagaaugacuugccgg

SEQ ID NO: 133 - RNA, 20 nt, Arabidopsis thaliana
ugacagaagagagugagcac

SEQ ID NO: 134 - RNA, 21 nt, Arabidopsis thaliana
uggagaagcagggcacgugca

SEQ ID NO: 135 - RNA, 21 nt, Arabidopsis thaliana
ugaagcugccagcaugaucua

SEQ ID NO: 136 - RNA, 21 nt, Arabidopsis thaliana
cagccaaggaugacuugccga

SEQ ID NO: 137 - RNA, 100 nt, Selaginella moellendorffii
ggagacugauuugacagaagaaagagagcacauuuggcugcacgcucuugguucuagugugucacucaugcgugcucuucuucuucugucauaucgcaac

SEQ ID NO: 138 - RNA, 103 nt, Selaginella moellendorffii
ggaucuauuguugacagaagacagggagcaccagcagccaccagcucuagagaggcuuuugggugcuugugcucucuauucuucugccaucaauccgacucgg

SEQ ID NO: 139 - RNA, 178 nt, Physcomitrella patens
aauuuugaaaccuucuuuugcuucauauucuagucguugguuuauggugccuaagaaaaauggaucguuauguuuuauucaagauauacagccaaugaauguaguaacuauaagaaaugcagguauaggaucuuuaauagaugaguuugcugaagcguuugggggaagggcaauuuau

SEQ ID NO: 140 - RNA, 235 nt, Selaginella moellendorffii
ggccucuggcauucgugcggcagugagggaggauuugccaauaauccauagugccauaaaggaagauguugcugugguuccuucacugugucaugaagugccuggagguccuccuugauugcagcacgcauaaccgcaacauucacugcucuagccauggcaaccacauccuccuucaaugcaccauggaucgcuugcaaauccucccucacugcugcacgaauggaucccauuc

SEQ ID NO: 141 - RNA, 140 nt, Triticum aestivum
gaagcacguggauagaggaagcacuacauuauggaauggagggaguauguuguaggcaaugauuguuugccuugaagauuuuauagauccugcucuggucuuucugauuuugucuguuccuuuuuuuuauguuugguucg

SEQ ID NO: 142 - RNA, 180 nt, Triticum aestivum
ccacgcguccggcauucuucuucuucuuguuguuguuguuguaauggauuuggaggaggaggaggaggaggagcugcuguugaugcuccuaguacaacaaauaaggaggcggcggaggaggagcaacaacaacaagaagaagaagauuugggcuugaagcugcagcugcaacaacaugua

SEQ ID NO: 143 - RNA, 99 nt, Vitis vinifera
uggugggaagcgugauguugggacggcucaaucaaaccaaagaucucaaugguugaguccuuuaaucugauugagccgugccaauaucauguucaauac

SEQ ID NO: 144 - RNA, 103 nt, Vitis vinifera
gaagaagguggggauguuggaauggcucaaucaaaucaaaucucccaaggguuuuggguccuuuaaucugauugagccgugccaauaucaucauguucacuuc

SEQ ID NO: 145 - RNA, 159 nt, Glycine max
uuaacagucguuauuugcggauguagcaucaucaagauucacaugcaagcgcagguggugggugggacuugaugcaaucuaagugcugugccagccaagccauaggucuuuuggaacugagaaucuugaugaugcugcaucagccauaaacgacuucac

SEQ ID NO: 146 - RNA, 133 nt, Arabidopsis thaliana
agcuacuguucgcuguuggagcaucaucaagauucacaaaucaucaaguauucguguaaauaaacccauuuaugauuagauuuuugauguauguaugagaaucuugaugaugcugcagcugcaaucaguggcu

SEQ ID NO: 147 - RNA, 174 nt, Zea mays
cagccagccggugauuucuggaguggcaucaucaagauucacacacugcaugccaacauaaugcgcguguucaugcauccaucgccgccgcugcaucaugcaucauauauaauauauauauauguguaugugugggaaucuugaugaugcugcauuggauaucaagggcuauau

SEQ ID NO: 148 - RNA, 123 nt, Sorghum bicolor
uagcucaggggugagaaucacagugcagcucuccuuuuggcaugaaggcugagagagucaugagcaguuuucuggccuuucccugccaaaggagagcugcccugccauucauuagcccugcaa

SEQ ID NO: 149 - RNA, 150 nt, Oryza sativa
ugcauuugcaccugcaccuacagagaggaagaugaagcagcaagcuagcaauacgugcuugaucgcuauacgcuagcuucuugcacacaauguuguuccuggucucuuccugaucccuaggugcagaggcagaugcaacuaugucauaga

SEQ ID NO: 150 - RNA, 149 nt, Physcomitrella patens
cuccccuuuucuacauucaagccggguuucgaagagagagagcacagcccuggacuuuucucaugugaccgauuuuagcgguacauggugcacugucaucgggcuguucucucucucuucuagacccuacuuggauguguuucuacugc

SEQ ID NO: 151 - RNA, 136 nt, Physcomitrella patens
cuagcuucuccacaauuucucacccucguugggaucagaagagagagagcacagcccgauguccaauguucaggucgaaugggcugugcucucucucuucuugcuccaacuugggugcuacacgcaucuaggguac

SEQ ID NO: 152 - RNA, 122 nt, Physcomitrella patens
ucagcaauuuacucacucaugcugggaucagaagagagagaguacagcccaagagcaaccgcuuaguuggaaugggcugugcucucucucuucugguuccaaccugagugcaugucgguugu

SEQ ID NO: 153 - RNA, 149 nt, Physcomitrella patens
ucaccuuuuucuacauucaagcugggguucgaagagagagagcacagucccagacuuuucacucacgaccacuuugagugucuuauggugaacaguagucgggcuguacucucucuuuuccagucccuacucgaauguguuucuaucgc

SEQ ID NO: 154 - RNA, 173 nt, Oryza sativa
cgccggcggccugacauugggaucggaggccauggugcagccaaggaugacuugccgaucgaucgaucuaucuaugaagcuaagcuagcuggccauggauccauccaucaauuggcaaguuguucuuggcuacaucuuggccccugcuccucauguaaggccggccuguggcg

SEQ ID NO: 155 - RNA, 102 nt, Sorghum bicolor
cagccaaggaugacuugccggauaugugcaugcauauguuacaaggcagcauaugcacccuguuacaagccugccuguucuccggcaaguuguccuuggcua

SEQ ID NO: 156 - RNA, 163 nt, Brassica napus
uauauguaucagagagucaugcaugggaaaauagagaaugauaaugagccaaagaugacuugccgauuuuaccaaagaauuuaaaacugauaauggugacuggcaagucgacuuuggcucuguuuccuucucuucuuuucgauguaagacucuagauaucuau

SEQ ID NO: 157 - RNA, 93 nt, Arabidopsis thaliana
augucuccuagaguuccucugagcacuucauuggggauacaauuuuucuaaaugauuauccacugaaguguuugggggaacucccggacccau

SEQ ID NO: 158 - RNA, 96 nt, Brassica napus
gaacaucauugagugcagcguugaugugauuuacuucucuuuuucauuguugaauggauuaaagcaauuuacaucaacguuggcucaauuauguuu

SEQ ID NO: 159 - RNA, 114 nt, Populus trichocarpa
uaauuauacaccauugagugcagcguugaugaaauucucuuguuagcuuacuuagcuauuuucucacgauggcguggaaucauuucaccagcgcugcauucaaccauguuuuuc

SEQ ID NO: 160 - RNA, 109 nt, Selaginella moellendorffii
auuuaguaguagcuagggagagacauugcaugauagcuacaccaaagagcaaccucggcuccuuguguggcuuugaugcacugccucuucccuggcugcggccaaguua

SEQ ID NO: 161 - RNA, 88 nt, Oryza sativa
aguggaaggggcaugcagaggagcaggagauucaguuugaagcuggacuucacuuuugccucucucuccugugcuugccucuuccauu

SEQ ID NO: 162 - RNA, 117 nt, Arabidopsis thaliana
ugcaagguaacgcgagauauuagugcgguucaaucaaauagucguccucuuaacucauggagaacgguguuguucgauugagccgugccaauaucacgcgguaaaccaaaaauggca

SEQ ID NO: 163 - RNA, 225 nt, Physcomitrella patens
cccacccugagcgggggggucugauuguggucggucgaggggcgcugaccguguggcccaauggauaaggcgcuugccuacggagcaagagauucuggguucgauccccagcauggucgugggucgccggaauuguagauuguggcgcgugucaauuuggccgagugguuaaggcggcagacucgaaaucugcugggguuuccccgcgcagguucaaauccugca

SEQ ID NO: 164 - RNA, 85 nt, Pinus taeda
gaugugugaaugaugcgggagcugauuuuguccaggaaaugucuuuuccuuggauugaagggagcucccuuauguagcauacauu

SEQ ID NO: 165 - RNA, 238 nt, Saccharum officinarum
ugaagacgacgacgaagaagaagauggcgaagaaaagugaucgaagagcucccuucgauccaauccaggaggggaaguggucgguugcagcugccgguucauggaugccucucuggugcagcaaugacuaaugcucaccugcacuugcaugggugugcaugacccgggagaugaacccaccaucaucuuucccucgugcuuggauugaagggagcuccucucucuuuccucucucucu

SEQ ID NO: 166 - RNA, 197 nt, Oryza sativa
gaggaggaagaggagcuccuuucgauccaauucaggagaggaagugguaggaugcagcugccgauucauggauaccucuggagugcauggcagcaaugcuguaggccugcacuugcauggguuugcaugacccgggagaugaacccaccauugucuuccucuauugauuggauugaagggagcuccacaucucucuc

SEQ ID NO: 167 - RNA, 189 nt, Oryza sativa
ugaugugaggaggagcuccuuucgauccaauucaggagaggaaguggugggaugcagcugccgguucauggauaccucugcaguucaugccgguaggccugcacuugcauggguuugcaugaccugggagaugaaccugccauuguguuccucuauugauuggauugaagggagcuccggcuacaccua

SEQ ID NO: 168 - RNA, 156 nt, Oryza sativa
gugagaaggaccgcguuggagaagcagggcacgugcaugcauauguucaucaucaucuucuuccuccuccucuagcuccagccuuguguggguuggaaguuuagauagaacucgcacugcacguggucuccuucuccaucccggucuuuuucucac

SEQ ID NO: 169 - RNA, 111 nt, Sorghum bicolor
gaggggcgagcaaaccgugcuggagaagcagggcacgugcucgucgucgcugcaugcguggucgucgucgcagcacgugcgcuccuucuccaacauggcuucucgccccca

SEQ ID NO: 170 - RNA, 119 nt, Oryza sativa
agguucuuguuggagaagcaggguacgugcaaaaugcacaccgguuggucgagcuaauuaacaagcucugacgaccauggugaucgaaugcacgugcuccccuucuccaccauggccuu

SEQ ID NO: 171 - RNA, 90 nt, Populus trichocarpa
ugagccaugcuggagaagcagggcacaugcuaaaucuaucagcuugaaagucugauaguuuugcaugugcucuaucucuccagcuuggac

SEQ ID NO: 172 - RNA, 280 nt, Triticum aestivum
  misc_feature (18)..(18): n is a, c, g or u
cggccgccauucagccanaagaagcagcgagccagcggagaccggcagccaaccaagggcgucgucgcuccaccauggaaucagcugcugauaugcucgaacacgaccugcaagcuucauguaucugcaacaccccugcuccucauccacgacccaagugaccugaaagagcaagcugcugcagagggcaauccucgauaucuaagaagaccucgggcuuauuaggggaagagagcucgugccagauccacucccaacugccuccguccaccauggacga

SEQ ID NO: 173 - RNA, 103 nt, Saccharum officinarum
ccgccccgcgccgucugggcucgcuugggcagaucgggacccgccgcccggccgacgggacggaucccgccuugcaccaagugaaucggagccggcgcagcca

SEQ ID NO: 174 - RNA, 106 nt, Oryza sativa
uggucuugugaggcuuggugcagcucgggaacuguucuugauggacuggcaggaacuccauguccaccacugccacuccuguguuguggcauuccuccuugccguu

SEQ ID NO: 175 - RNA, 126 nt, Sorghum bicolor
uggcgagagccugccuuugguagccaaggaugacuugccuacacggccuugcgaguuccgguugcauggccaguucaguuggguuugugggcggucaccuuggcuagccugaguggcucuugccug

SEQ ID NO: 176 - RNA, 169 nt, Sorghum bicolor
gauggagagcccccuuuugcuagccaagaaugacuugccuaugcaugcccucuguuggcaauuccuccagccauggagauugcacaaggugaauuuuugcggcauagaugauggaugcaauguggcugcaugggcaggucuucuuggcuagccagagugcucucaucca

SEQ ID NO: 177 - RNA, 118 nt, Populus trichocarpa
ugcuguuuucuagccaaggaugacuugcucguuagcccuugaaagauguuucaaauuuaggcugcauaugcucagaaccuuuuucuggcuucaggcaaucaucuuggcuaaaugacag

SEQ ID NO: 178 - RNA, 124 nt, Sorghum bicolor
aggaggaagaagacgacauggcgugguauuguuucggcucauguccuucuugcuucgagucugucgucggauuuuggaugugaugugagccgaaccaauaucacucauguauucuucauucuga

SEQ ID NO: 179 - RNA, 119 nt, Sorghum bicolor
ugagagaauaagacgacauggcgugauguuguuucggcucaugcauauccuucuugaguguaucaucaggaaagaggcgaugagccgaaccaauaucacucauguauucuucauucaua

SEQ ID NO: 180 - RNA, 129 nt, Medicago truncatula
uaaaguaagcaaaucagucauagggcaugucucuauuggcaggugauauggugauauuucauuugacuuuaaggcucuaaaaauucacuugccaaaggagagcugcccuacgaguguuuagcuuaaaca

SEQ ID NO: 181 - RNA, 85 nt, Physcomitrella patens
guugcuuuuuccucucccucaaaggcuuccaacaugaugugcguaagccacaacguuagaagccuuugugggagaggaagaaaca

SEQ ID NO: 182 - RNA, 272 nt, Arabidopsis thaliana
uuuuggagcaaaagcuaaggaaaaggaagauaaggacgauuuugguucuggaauuagcgaggagugucgaucgacacacucuuggugucgaucgacaccaguuucggcccagcaaaaacccuagacgcuuucgaguuuacaagagcucaaguuugcccuagaagauuucauuauuugcauuauuaguccguggacguuuuuagggucuauauauauuguuuuuagaccuaaguuucuuuuaucaagucuuuuaucaagcuuuugcaaaacca

SEQ ID NO: 183 - RNA, 171 nt, Physcomitrella patens
augaaaguucuugagacacucucuaggucugagaaagacuugagaggacacuccuacaauagccucgggaacugcaugacguuuuucauuagaugaggugguucccugagcauuugcaggacaguucuuucaagccuuccucggacuuuggauuguuuguuccauaucaug

SEQ ID NO: 184 - RNA, 221 nt, Physcomitrella patens
uaaaaaaaauaauauguugauaauauaugugaaaguaaauaaguauuaccuaagauaaguugcuaaaaggucaaaggcagcaaagguaaaaguaaguaacaaugguggcgacuagguuuaugauggcagcuaggauuuaagaggcggcuagguaaaguggcggcuagguuaaguggcgacuaggguuucaucaaauggauguagaugaaguucagccauag

SEQ ID NO: 185 - RNA, 151 nt, Sorghum bicolor
caaguugaagguuagguuaaugggguuguugucugguucaaggucgccacagcagacaaagcccauuuugcuuagcaugcagcauggguuuaucucuauugaugaucgaucucggaccaggcuucaaucccuuuaacuagcaucugcauau

SEQ ID NO: 186 - RNA, 137 nt, Sorghum bicolor
uaccguccgccggcgaauuacggggcaguucgucuuuggcacaaaggcacguccagaacuacucgaugagggucacuugagcugaacugaacaugcgugccaaaggagaauugcccugcgauucgcccgugcagaag

SEQ ID NO: 187 - RNA, 101 nt, Populus trichocarpa
uuaugcaugcugacagaagagagggagcacaacccuguaauagcuaaagagagucuuugcuuuuguuggacugugcuuucucuucuucugucaccaaccaa

SEQ ID NO: 188 - RNA, 138 nt, Oryza sativa
aucgugaaggcuaaauggagaagagagagaguacagcuuugggcgguuuaguuguuagaugguggaaguacuugcgacgccuacuacccuuuucaccaaggcuguacgcucccucuucuucucuuagcuuuuuaugau

SEQ ID NO: 189 - RNA, 101 nt, Vitis vinifera
uguaauugcuugacaacgagagagagcacgcuagucagcauucaugcgaggaacaugacuguguacaggcgugcucucucucgcugucauacaaucuucuc

SEQ ID NO: 190 - RNA, 108 nt, Populus trichocarpa
cuagaguccgagccaagaaugacuugccggcaggcuagcauuugcuagcuacagggcaagauguaugcuaaagugacauuccgccagguuguucuuggcucuacuuug

SEQ ID NO: 191 - RNA, 123 nt, Arabidopsis thaliana
caagagaaacgcaaagaaacugacagaagagagugagcacacaaaggcaauuugcauaucauugcacuugcuucucuugcgugcucacugcucuuucugucagauuccggugcugaucucuuu

SEQ ID NO: 192 - RNA, 113 nt, Arabidopsis thaliana
gggugagaaucuccauguuggagaagcagggcacgugcaaaccaacaaacacgaaauccgucucauuugcuuauuugcacguacuuaacuucuccaacaugagcucuucaccc

SEQ ID NO: 193 - RNA, 138 nt, Arabidopsis thaliana
uggugcaccggcaucugaugaagcugccagcaugaucuaauuagcuuucuuuauccuuuguuguguuucaugacgaugguuaagagaucagucucgauuagaucauguucgcaguuucacccguugacugucgcaccc

SEQ ID NO: 194 - RNA, 226 nt, Arabidopsis thaliana; identical to SEQ ID NO: 12

SEQ ID NO: 195 - DNA, 803 bp, Zea mays
ttcggttgttatttaatcacaaggtgcagcagcaagcagttccctgcattttatgagccttacctttttctccctcctgaatggaaggtaacagtgtcactcactgcatttcataacgtgctatctatcttgacaactctgcctactgcaggctgcagctgaaagaaatgaacagaacaaggggaaatagttgtccttggacaagaaacctcagccccattgcaccggatggtatggtcgaccgatcgaaagcgcgggatacactgctagctgcatctcgtcaggtccatccgtccatcctagggatcggtttcagataaggggcccgcccggactagccaaggagactgcctgtgatcgaggccacgaggcgagcaataaaacgtgcacaaggttttgcccgagccaagccaagccaagaagccacaggcaagtcatccttggctatctggacagactcttatcgccactctctagcacactgcacacacacaaatctgtggccttggattggatgcaacgctctgcgtgcccttcggctatttatactgtccaagtacagaaacgagctggtggatccaaagcttttcttccatgacagaaacggccgcaggttgcagcatcgaacatatcctcagctcctctctctctctctccttttttttctccttgaaatgtgcacatccatccagattacgcatgcccatattttcaagggatccctattttcaatcattcagtggtgtggtgcaccttatcgcctgccgaaattagaaaaaccccgggaccgggaataatatggc

SEQ ID NO: 196 - DNA, 1174 bp, Zea mays
ccaatctgaggtaggagaagcaccccctcctcgcatcgcgtcacgcccccaccaccactgccgtaggcttctctccggcgctcccactcggccgcacgctcagcctcagcatgccaccgccatcgccgtctcgcccgctattgcccgcttcccgctgtcccctgcaccgctgccgcttgtaggctcctccacctccgccgcctcctcgagctctgtcgcgcgaggccattttttagtggggaatgcgatgtccactttctcatctcctgtggcctgcaccatttgcgtacatcactagggcctcaatcattgaacacaggggtcatcggctaccagcgctaggatcatgtgtgaccaatcgctgcttgcgatttgcgaaccgccggatcaaggcgtgggagcaaagctttagctgccaaaggggcggaagcggaagagggcagcacattctgtagtctctatccattttttggcaccataaacgagccaatcgtatcaaaaattttatccaaagcaatctaaagccacctctcgagtgcagggatgtcaagctacaagaaactctcacagataaagaaaagaaggttgaccctccacttcaatctcctccaaaaagccgccgaggagcgtaaaatagatttgcttgcacccgcacattccgggcgcagccgtgcagccaaccaatcagaaatgcaggcgcagtcaacactcgtgaggagcctaggcgttgagagctgggcaaccaatcacacggtaattgtatgcacccatgcacaggtcgaggaggctcctgtgtctaattgtgtgcagcaagtcaaagagtctcgattgagcctagcatgagcaataggggccactcaggctagccaaggagactgcctacgaaccaacacaaaggtccacaattctgatcctttgtaaacaaaggacataggcaagtcatccttggctatcagaggcaggcccttattgacatgtaaggcttctgctctgcttgtcacctctagctagcttggtagcttctgtgactggtctgttgtgctccttccatggaacatctatttatacatgtatctcgtagagagaaccgtatcattttttccttttttttgttgttgttccaggacatcttattctctaattggatagcagcatatattctagcttttttact

SEQ ID NO: 197 - DNA, 1188 bp, Zea mays
  misc_feature (1179)..(1179): n is a, c, g, or t
gcacgagggaccagaggaagggacggcggggaggtggcaaggcgcagagagcaggttcgcttggcggacgcaccgagggaggcgtgtgggagccatgcttcttccctcttcgtcttcgtcttccgcttccgcttccaaaggtaactcctttgggaaaaccgttaacgatcatctgaggtcaactttgagttttgataacaagcaacctccatttgcgagtcaaaactttgactacggtcaaacaatagcttgcatttcatacccgtacaatcgttctagatcaggagatgtttgggcagcctatgagtcacgcaccagcactgccactgtgttccgttcccaaattgctggtgggggttcatccacaagaattcccttgcctttggaattagcagagaatgaacccatatatgtgaatcccaaacaatatcacgggatacttcgcagaagacagttacgtgccaagctagaggctcagaacaagctagtcagagcccgaaagccttaccttcatgagtctaggcatcttcatgcaatgaagagggcacgaggttccggtggacgattcctcaacactaagcagctccagcagtctcacacagccctcaccaggtccaccaccacaagtggcacaagctcctcaggctcaactcatctgcggcttggtggtggcgcagccgcagctggagatcgatctgtgctggcacccaaaacaatggcctcacaagacagtagcaagaaggccgtttcttcagccctcgccttcactgcgactccaatgctgcgcagagatgacggcttcttgcagcacccaagccatcttttcagtttttctggtcattttgggcaggcaagcgcgcaagctggcgtccataatggaagtcagcatagggttccagttatgagatgaccggtttgcgaaccatagctggtgatccaggcgtctagggtcaacttcgctgtggtgtcttagtctctcaggcaattcatccttggcttaatttctggctttttattagaaggtaccaaaatgtgttccataccgttgtggccacagagcccataaaccagggggtttgatggttggcactcctacccaaactattgttgcagtggtgtttgttagaataacccttgactattattctgtacaatttgcctttatcttgtactgccaanttattgtgt

SEQ ID NO: 198 - DNA, 1475 bp, Zea mays
gcacccgttataatctatacggttcaagggaccgaagaaggtagagagagaaacttgaaggggagaggaaggagatacaggttcatgttcatttaggtgtcagttcatctgatttctcagaagcaaaatgttgtttggagctcagtgacaccattttgtaatgcatgtgccttttacgggaaatggaggatcattatgtccatcccaagtctaagtctaaccatggctccttgtcaggaaatggttatgagatgaaaaatccaggccatgaagtttgtgatagggattcatcatcagagtctgatcgatctcacccagaagcatcagcagtgagtgaaagcagtctagatgaacacacatcaactcaatcagacaatgatgaagatcatgggaaggataatcaggacacattgaagccagtattgtccttggggaaggaagggtctgcctttttggccccaaaaatagattacaacccatcttttgcttatattccttatactgctgatgcttactatggtggcgttggggtcttgacaggatatgctccacataccattgtccatccccagcaaaatgatacaacaaatagtccggttatgttgcctgcggaacctgcagaagaagaaccaatatatgtcaatgcaaaacaataccatgcaatccttaggaggaggcagacacgtgctaaactggaggcgcagaacaagatggtgaaaggccggaagccataccttcatgagtctcgacaccgtcatgccatgaagcgggcccgtggctcaggagggcggttcctcaacacaaagcagcagccccaggagcagaaccagcagtaccaggcgtcgagtggttcaatgtgctcaaagaccattggcaacagcgtaatctcccaaagtggccccatttgcacgccctcttctgacgctgcaggtgcttcagcagccagccaggaccgcggctgcttgccctcggtgggcttccgccccacagccaacttcagtgagcaaggtggaggcggctcgaagctggtcgtgaacggcatgcagcagcgtgtttccaccataaggtgaagagaagtgggcacgacaccattcccaggcgcgcactgcctgtggcaactcatccttggcttttgaaactatggatatgcaatggacatgtagcttcgagttcctcagaataaccaaacgtgaagaatatgcaaagtccttttgagatttgctgtagctgaaagaactgtggttaggttatgagtttcttcctggagactgatccatacatgacatgctacctcgtgctgagtttctgaggtgaagccatcgaaacatgaccgtgtggttcagtacccttgctgccttcagtgtctgataagctagctctccagtttgcagtttctctgaattccagcatgtctagtctctgcttatcttttgcatgtaacgtgatggtgacttagcatacacatctattcatcc

SEQ ID NO: 199 - DNA, 1217 bp, Zea mays
  misc_feature (7)..(7): n is a, c, g, or t
gtccggnattaaccgctcgaccccgcgtccggagaatttaaaaagggactggatgacgcgaagaggagacaagaatcaaatgtttttggagattgagtgatgcgatctgatagtgaaaatgcttctgcgagaaatggatggtgatccattccatcccatgcccagctatgatttcctgtctgggaacggttattcattaaagcagttagtgcgcagcaactctgatatagactcttcatcatccaagtctaagcagtcttggcaagacttatctgacagcagcctcagtggacaacacacaccaacgcaatctgataacaacgatatttgtggaaagcgggaccagggcatggtgaagtctgtattgtcctttagtagcccggaagctgcctttccccctcacaaggcttgtgcttcttatagtgctgatccatattatggcggggtgtgggcaggatacgcttcaaatggaattgtccatccccaaattagtggtgcagcaaacactagggtaccattgccagttgggcctgcagcagaggaacccatatttgtcaatgcaaagcaatacaatgctatcctccggaggaggcaaaaacgcgcaaaactggaggcccaaaataaactggtgaaaggtcggaagccatatctccatgaatctcggcatcgtcatgcaatgaagcgagtccgtggaccagggggcgtttcctcaacaaaaaggagctccaggagcagcagctgaaggccctgccttcacttcagactccaacaggtggggtcagcaaaatggcctttggcaggaacctatgccctgaaagcagcacatctcactcgccttcgacgagctctacaatctcgagtgctacaaactggagtggcacgctagctcatcaagagcacgttagcttcgcttctgctaataaattcctccccagcatgaacttccacgcggagaatggaggtgaaaagatggccatcaatggcgtccgccaccacacccctgtcctgaggtgaacagcctcaactgtgggggtgctgtgctggtaccatcactggcgcgctccggtgtgcccgtggcaattcatccttggcttatgatgtatcttatagtaatttgctttcactttcatatggaacttgtctcagattaaactcggtgatatttattgcaactggatgactgaaataatctcatgtttcttacaagggtgtgagcc

SEQ ID NO: 200 - DNA, 1398 bp, Zea mays
gttcgacgtatttctctctctatctatacgattccgaagaaggtagagagagaaactcgaaggggagaggacagaagagggagatacaggttaatttttaggtaccagatcatctgatttctcagaagcaaaatgttgtttggagctcagtgacaccatcttgtaatgcctgtgattttacgggaaatggaggatcattctgtccatcccatgtctaagtctaaccatggctccttgtcaggaaatggttatgagatgaaacattcaggccataaagtttgcgatagggattcatcatcggagtctgatcggtctcaccaagaagcatcagcagcaagtgaaagcagtccaaatgaacacacatcaactcaatcagacaatgatgaagatcatgggaaagataatcaggacacaatgaagccagtattgtccttggggaaggaaggctctgcctttttggccccaaaattacattacagcccatcttttgcttgtattccttatacttctgatgcttattatagtgcggttggggtcttgacaggatatcctccacatgccattgtccatccccagcaaaatgatacaacgaacactccgggtatgttacctgtggaacctgcagaagaaccaatatatgttaatgcaaaacaataccatgcaatccttaggaggaggcaaacacgtgctaaattggaggcccagaacaagatggtgaaaaatcggaagccatatcttcatgagtcccgacatcgtcatgccatgaaacgggctcgtggatcaggaggacggttcctcaacacaaagcagctccaggagcagaaccagcagtatcaggcatcgagtggttcattgtgctcaaagatcattgccaacagcataatctcccaaagtggccccacctgcacgccctcttctggcactgcaggtgcttcaacagccggccaggaccgcagctgcttgccctcagttggcttccgccccacgacaaacttcagtgaccaaggtcgaggaggcttgaagctggccgtgatcggcatgcagcagcgtgtttccaccataaggtgaagagaagtgggcacaacaccattcccaggcacactgcctgtggcaactcatccttggctcttggaactttgaatatgcaatcgacatgtagcttgagatcctcagaataaaccaaaccttcagttatatgcaagccttttttgaggttgctgttgctgtacctgagaactgtggttaggttatgagtttgttcctcaaaactgacccatacatgacatgctaccttgtgctgagtttttgagacaaagccatcgaaacatgatcttgtggttcagtactttgctgccattagtgtctgataaactagctccccagtttgcagtttttttg

SEQ ID NO: 201 - DNA, 668 bp, Zea mays
ccatgaaacgggctgatggatcaggaggacggttcctcaacacaaagcagctccaggagcagaaccagcagtatcaggcatcgagtggttcattgtgctcaaagatcattgccaacagcataatctcccaaagtggccccacctgcacgccctcttctggcactgcaggtgcttcaacagccggccaggtccgcagctgcttgccctcagttggcttccgccccacgacaaacttcagtgaccaaggtcgaggaggcttgaagctggccgtgatcggcatgcagcagcgtgtttccaccataaggtgaagagaagtgggcacaacaccattcccaggcacactgcctgtggcaactcatccttggctcttggaactttgaatatgcaatcgacatgtagcttgagatcctcagaataaaccaaaccttcagttatatgcaagccttttttgaggttgctgttgctgtacctgagaactgtggttaggttatgagtttgttcctcaaaactgacccatacatgacatgctaccttgtgctgagtttctgagacaaagccatcgaaacatgatcttgtggttcagtactttgctgccattagtgtctgataaactagctcccccagtttgcagtttctctgaattccagccatgtctagcctcaaaaaaa

SEQ ID NO: 202 - DNA, 1548 bp, Zea mays
cacatctcacctcgcgtgatcaattgagggcctactagcttactactgctgccttagtttcctttttcatgaatacagttacggtgggaaggtcaaattctgttgtgtattcatgcatcagctgtgctccttaaggcttgcagaccttaatacccagtacgtgtttcgaatctcgtatgtttatttctgggaactgacctgtgtttatatatgtttggacagtacgaactgaaaaacaagagtaaagaatttccgtgagatgagacgtacgtaaggataatccccaagacattgctcaatctgtttctctctctctctctctcttttcggcgagcagtttgtcctttttctttcaatttcttttactactacacccgttatcgaatatttgtcatccgctggctcatttataaactaaaacacgataaataaagaaggaaagaacggagagagtagtagtggtttagtttcatgcagctagaattctaacgccctcctggatccttgtgcagagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctccctcgtctgaaactgaactctctgcaactactgtaactgtaactaaactgggtgtgcccggattggcggtcgttctgttctactactagtacctgctacgcgtcgttgggttgggtctggactagagagcgtgctggttctttgatgaacttggctggacttgagggtgttgactagcgcgaagctgagttccatgtaaaacttttgcttcaagaccgatgactggcggcataataagtagcagtaataacc

SEQ ID NO: 203 - DNA, 1198 bp, Zea mays
ggatcccccgggctgtttgaattcggcacgaggagagagagggaggagaccttgcagaggagcgaagcaagcaaggtgggaaagaggcagcagcaagggcggcgggctgccggaaggggaacatgctccctcctcatctcacagagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcgcataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgccgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctcgctcgtctgaaactgaactctctgcaactactgtaactgtaactaaactgggtgtgcccggattggcggtcgttctgttctactactactagtaccttagtacctgctacgcgtcgttgggtctggactagagagccgtgctggttctttgatgaacttggctggacttgaggtgttgactagcgcgaaactgagttccatgtaaacttttgcttcaagaccgatgactggcggcataataagtagcagtaataaccattcttctgtgtc

SEQ ID NO: 204 - DNA, 1564 bp, Zea mays
gtctgtgtgcgagcgcaagagaaagggagtcagagagagagagagagggaggagaccttgcagaggagcgaagcaagcaaggtgggaaagaggcagcagcaagggcggcgggctgccggaaggggaacatgctccctcctcatctcacagagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcgtaagtgatctccatgcgtccagcctgttgtttcactacttgctgccggtgctagatgatgccctttgtccactttgaagacactttgctaggcaatgcggtcagtactggtgctttctttttgtttttcctgtgcgttattgcgtttagtggtgttcttcatttgctagcacagcatgcctatcggctgagacagcacccagcagcattgccatcgatttaccccttcaactcattcgtctcgtcagatcttactcctgctatgttattgaagcataggcgttttttacgtttcacgcctgcatcattgccattctcctggtcctgggtaaagcggcttgttttttttcttcttctgataattacaaattaatcagagtctcgtattttgcctggtaaacaaatcgagcagatgcaccctcagctggttggcatggttccgtcctctcgagtgcccctgccgatcgagccagccgctgaagagcccatctatgtcaacgcgaagcagtaccccgctattctccggaggagacagctccgtgcaaagctagaggctgaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctcgctcgtctgaaactgaactctctgcaactactgtaactgtaactaaactgggtgtgcccggattggcggtcgttctgttctactactagtacctgagtacctgctacgcgtcgttgctggttctttgatgaacttggctggacttgaggtgttgactagcgcgaagctgagttccatgtaaacttttgcttcaagaccgatgactggcggcataataa

SEQ ID NO: 205 - DNA, 417 bp, Zea mays
agtaatagatattatgccctccattttagatatagattggaagtgtatgtgtggtgtataactgtatagaatttcttcaattcatggtgagattgttggaaagaaagaaagaaaaaactccttgaattaatccattgttgctgcccaatataatgcatggtcagaggtatccactcttgtcgactgaatatatatcctcccagcagctttgtatcaaatcagatcgaccaccgcatgcaaaaccccttgaactaatcaaccacgtcccagctaggcacagcatctcgtgtgcgtccacgagcagatgaaactgcacagcatgatctgatcgctagctgcttccatatatatgctgtggacacctcagatcatgctggcagcttcagctactagaggacacaccaaccccaacacaat

SEQ ID NO: 206 - DNA, 2407 bp, Zea mays
tccaaagaattcggcacgacactggctggagtgtgtttgtcagtgctaagagacttgttgctggagattctgtgctattcatatggaatgagaaaaaccagcttttgcttggaatcagacacgctacccggccacagactgtgatgccctcttctgttctttcgagtgacagcatgcacatcggactccttgcagcagcagctcatgctgctgcaacaaacagccgcttcacaattttctataatcctagggcaagtccaacagaatttgttatacccctttcgaaatacatcaaggctgtttttcacacgcggatatcagttgggatgcgattcaggatgttatttgagactgaggaatcaagtgtccgcaggtacatggggacaataacagaagtgagtgatgctgacccagtgcgttggcctagttcctattggagatcagtgaaggttggttgggatgaatcaaccgcaggagaaaggccacctagagtttctctgtgggaaattgagccactgacaacctttcctatgtatccatccctgttcccactgcgagttaagcatccttggtattcaggacttgctgctcttcatgatgacagcaatgctttgatgtggctgagaggagtaaccggtgaagggggctttcattctttgaacttccagtcacctggtataggttcctggggacaacagagactccatccatccttacttagcaatgaccatgatcagtatcaagcagtggttgctgccgcagctgcctcccagtccggtggttatctgaagcagcaattcctacaccttcaacaacctatgcagtccccacaggagcagtgcaatctcaatccgctgttgcagcaacaaatactacagcaagcgagccaacagcagatggttagttctgatgctcaaaatattcagtccgtgctcaacccaggtgctattcagcagcagctccaccaactccagcagatgcagcatactcataatgaccagaagcaaaagattcaaccagatcaacagtaccaagttgctagcagtgcggttctcccgagtccaacatcattaccaagccatttgcgtgaaaaatttggcttctctgatcctaatgtgaactcttccagcttcatcagctctagcagcaacgaaaacatgctggaatcaaacttccttcaggtaagttcaaaatccgtggatttgtctagattcaaccaaccagtagttagcgagcagcagcagccgcaacaacaacaggcatggaagcaaaagtttatgggctcacagtcaatgtcttttgggggctcggtttcgcttaactcgcccactagcaaagatggttctgttgacaacaaagttggtcgtgatgtgcagaaccagtccctttttagccctcaagtcgactcttcctccctactgtacaatatggtacctaatcttacctcaaatgttgctgataataatatatcagcgtttccctctggatcaacatatctgcaaagtccaatgtatggttgtctggatgactcttctggtttattgcaaaatacaggagagaatgatccgacaactagaacttttgttaaggtaagtataatccgagtctactaaaaaacaaatttaagcccttcctcatgtaatcattttttaaaattcaggtttacaagtcaggatcagtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccgtgggagtcatttgtgaatagtgtatggtacatcaagatactttcacctgaggatgtgcataagatgggaaagccaggaaacgatccacgctacctatcttagctacctatcttaaatcgatacatggagctctttctggctcccatgacgattctgcggcacactgcagcactgttcacgacggcctgctctactgtgctcgcatgttcgcccgtgtcatctctactctctagcatgcacaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgtttgagatttgtacttcagttttgtgtctgccggttta

SEQ ID NO: 207 - DNA, 1097 bp, Zea mays
ccttcagggaagctcaaaatctgtggatttgtctagattcaaccaacctgtagttagcgagcagcagcagcaacaggcatggaagcaaaagtttatgggctcacagtcgatgtcttttgggggctcggtttcacttaactcacccactaccaaagatggtcctgttgacaacaaaattggtcgtgatgtgcagaaccagaccctttttagccctcaagttgactcttcctccctactgtacaatatggtacctaatttgacctcaaatgttgcggataataatatatcaacgattccctctggatcaacatatctgcaaagtccaatgtatggttgtctggatgactcttctggtttattgcaaaatacaggagagaatgatccgacaactagaacattcgttaaggtttacaagtcaggatcggtggggagatccttggacatcacccggttctctaattatgctgaacttcgagaggaactgggtcagatgttcggcattaagggtcagttggatgaccctgatagatcaggctggcagcttgtatttgtcgacagggagaacgatgtgcttctccttggagacgacccgtgggagtcatttgtgaatagtgtatggtacatcaaaatactttcacctgaggatgtgcataagatgggaaagccaggaaacgatccacgctacctatcttaaattgatacccagagctctttcgggctcccgtgacgattctgtggcacactgtagcactgtccatggcggtccggtgtgctgtgctcccatgttcgctggtgtcacctctagcatgtacaccgtgcgcgtcttcagaactcccccgttacttgtatccggtgcaggccaccgctctggactgatatcttgtaggttccacttaggaatcagtatcagcgactctatcctagttggtttgtagctcgcacggcactcgttcttgtgtcgcatcgaaatcttcaggctaaatgcttagttgaaactgttcccgtgattcttaagctatctatgtatttgaggattccccggcatgctttcgacgatgaactgcaataatctgaatgcaggaggattgtttgaatgc

SEQ ID NO: 208 - DNA, 1001 bp, Zea mays
tgggggctcggtttcgcttaactcgcccactagcaaagatggttctgttgacaacaaagttggtcgtgatgtgcagaaccagtccctttttagccctcaagtcgactcttcctccctactgtacaatatggtacctaatcttacctcaaatgttgctgataataatatatcagcgtttccctctggatcaacatatctgcaaagtccaatgtatggttgtctggatgactcttctggtttattgcaaaatacaggagagaatgatccgacaactagaacttttgttaaggtttacaagtcaggatcagtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccgtgggagtcatttgtgaatagtgtatggtacatcaagatactttcacctgaggatgtgcataagatgggaaagccaggaaacgatccacgctacctatcttagctacctatcttaaatcgatacatggagctctttctggctcccatgacgattctgcggcacactgtagcactgttcacgacggcctgctctactgtgctcgcatgttcgcccgtgtcatctgtagcatgcaccaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgtttgagatt

SEQ ID NO: 209 - DNA, 707 bp, Zea mays
acgatgttcggcattaagggtcagttggacgaccctgatagatcaggctggcagcttgtatttgtcgacagggagaacgatgtgcttctccttggagacgacccggggagtaagaaaccatcactacaattatagtttcaaattgtgattttcaatagtatatacatttgaattttttatatctttacaatgtattagaaaaaatatcacactgcatagttcacgctctgatagagtgatagtaacttgtttttttttttgtttaatttgggtaggcagtttttttacccaactgcccattagcctcatcaatatctattgtcccttgcatttgaatggacctacatgttgttttcaatggctcctgatgacctcagacatatctacatgggcttgattctggcatacatctactatatgcattcaagttacaaaaatgattaatccacgtcccttgatttatgatacttcaatactcaggaagccattttagctaatggctctcagtgtcagcctgataactggggtttgggggtcatctcggtcatgcgaacgagttgttttgtcttaatgcaacacccgggggaggtcttcctccctcctttattacaaactaaagcttacttgtgatacggatatcatgtttctggatattttaagtgatggatgcaacatatcaatcttagtgtgtgcattattatgcatgc

SEQ ID NO: 210 - DNA, 722 bp, Zea mays
  misc_feature (24)..(24): n is a, c, g, or t
  misc_feature (607)..(607): n is a, c, g, or t
catcggtcccagcgtcttgtccgnattcccgggccgaccccgcgtccgctggatgactcttctggtttattgcaaatacaggagagaatgatctgacaactagaacattcgttaaggtttacaagtcaggatcggtggggagatccttggacatcacccggttctctaattatgctgaacttcgagaagaactgggtcagatgttcggcattaagggtcagttggatgaccctgatagatcaggctggcagcttgtatttgtcgacagggagaacgatgtgcttctccttggagacgacccctgggagtcatttgtgaatagtgtatggtacatcaaaatactttcacctgaggatgtgcataagatgggaaagccaggaaacgatccacgctacctatcttaaattgatacccagagctctttcgggctcccgtgacgattctgtggcacactgtagcactgtccatggcggtccggtgtgctgtgctcgcatgttcgcccgtgccacctctagcatgtacaccgtgcgcgtcttcagaactcccccgttacttgtatccggtgcaggccaccgctctggactgatatcttgtaggttccacttangaatcagtatcagcgactctatcctagttggtttgtagctcgcacggcactcgttcttgtgtcgcatcgaaatcttcaggctaaatgcttagttgaaactgttcccgtgattctt

SEQ ID NO: 211 - DNA, 721 bp, Zea mays
cattgtgttggggtcggaaggttgctcgacatcactagattcagcagctacgacgagctccgtagcgaggtggggcgtctgtttggcctcgagggccagctggaagaccctctgagatcaggctggcagcttgtatttgttgacagggaggacgatgtccttctggttggcgatgacccatggcaggaattcgtgaacagtgtgtcctgtataaagatactttcaccggaggaggtccagcggatgggaaagccgggcatccagctcctgagctcggctccttcaagaaggctgggcaatggctgcgacagctacgcgagcatgcaggagccgagaggcctggacgctgggatggcgccggtgggttcggtcgagttctgaagacggcggagggaagcccaccatggccctcgggtcgaggattactctccctcctgtatgtttctgcagcacttgctagctctgcgacttggaacaaagcacgtagatcaaatggagctctgtgctgctccccgtctgatgatgtcttatggtatagactcgtagcagtaactactacatgttgtatacatgccggcacttcagttcttatcgagtagcaataccgctagtttagtccatccaatcaactacgttcttgttcctatgatcctgttgttgcgatgcagtaaaaccttttttttgtcataataacctgtatattgaaactgttcttggctcc

SEQ ID NO: 212 - DNA, 1483 bp, Zea mays
cacagtgtctgccagtcccccaacatcagcaaatgcaacaacagaatatgaccaactaccagtctatatctaatgcattatcaccgttttctcagctgtcgccagtttctcagtcttcacctatggcgctgcagactatattaccgttctcgcaggcacagagcttcacagacacgaatgtaggttcattgtctccatccaatggtaacaccatgcaaaacacactgaggccgttctcatcagaagcagtttctcacctcagtatgccgaggcccactgcgatacctgtcgcagacccatggtcgtcgaagcgtgtcgcggtggagtctctgcttccttctcggcctcaggtttcatcccagatggaacaattggaccctgcaccagctagtatacctcatagctctgcgttggcaccacttcccggaagagggtgcttggttgaccaagatgtgaactctgatcctcaaaatcatctcttgttcggtgttagtatagactcgcagtcactgctaatgcaagggggcattcctggtctccaaaacgggaatgattcagctgctataccttattccacttccaatttcctcagcccttctcagaatgactttcctctggaccatacactaaattcttcaggctgcttagatgattctgggtacgtcccgccatgttcagataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagaccctctgagatcaggctggcagcttgtattcgtcgaccgcgaggaggacgtccttctcgtgggcgacgacccttggcagtaatttaccatgaccgtccatcagtcttgggaattcgcgagcacggtgtcctgcataaagatactctcgccgcaggaggtgcagcagatgggcaagcagggcctggagctcctgagctcggcccccgcggcgcggaggctaggtagcagctgcgacggctacgttagcaggcaggagtcgaggagcctaagcaccgggatcgcgtccgtgggttcggtcgagttctgaaacagaaggcaggagctcgttacgcgccccgagcttagtttagggctggcctgtgacggacccgctcgctcggctcgcgcttcctatgttttttgcagtccatggcgtcgaggtggaagcagcaccagacccagcattagctctccttccaggttatgtactaccatctaataattctgtccagtcgtatatgacacccaactcccaagtagaagaaactaccagcagccgctgtcggtacacatgctgaaacttggctattgtttggagaaacactaatcctgtgaatgtagccaggcaggctctgtaacgatccatgagttaatagcccttttgttgca

SEQ ID NO: 213 - DNA, 1272 bp, Zea mays
  misc_feature (29)..(29): n is a, c, g, or t
gtactggtacgcctccagttccggtccgnattccggctcgaccccgcgtccgcacctcagtatgccgaggcccactgcgatacctgtcgcagacccatggtcgtcgaagcgtgtcgcggtggagtctctgcttccttctcggcctcaggtttcatcccagatggaacaattggaccctgcaccagctagtatacctcatagctctgcgttggcaccacttcccggaagagggtgcttggttgaccaagatgtgaactctgatcctcaaaatcatctcttgttcggtgttagtatagactcgcagtcactgctaatgcaagggggcattcctggtctccaaaacgggaatgattcagctgctataccttattccacttccaatttcctcagcccttctcagaatgactttcctctggaccatacactaaattcttcaggctgcttagatgattctgggtacgtcccgccatgttcagataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcaggaattcgtgagcacggtgtcctgcataaagatcctctccccgcaggaggtgcagcagatggggaagcagggcctggagctcctgagctcggcccccgcgcggaggctcggtagcagctgtgacgactacgtcagcaggcaggagtcgagaagcctgagcaccgggatcgcgtccgtcggttcggtcgagttgggatgagcagcaagatagcgcgcacgcagcagcagcagcagcaggttacgcatcctcagcctcagggtaggtaggggactgaagggttggtctgcgacttgatgacccacgagctcctcgttgcgcgcttcgttcgcctccatgcgatggatagaagttcagcgcagaccaagccttagctctgcgagctatgtaccatctaataattctgtccgtgtcgtaccatgtcaactcctaagtagaagaattgaagaaactaccagcagccgctgtctggtatacacgctgaaacattttttttcttgtatggagaaatactaatcatctggatgtagccaggcctatgctctctaatggttgatcgggta

SEQ ID NO: 214 - DNA, 696 bp, Zea mays
acgatttccccttgaatcaaccgctacgcagcgcgggctgcttagatgagtcggattatcttccatgtgcagagaatgccgaacaggcaaatcaacagtttgcaacctttgtgaaggtttacaaatccgggaccgtcggaaggttgctcgacatcactagattcagcagctaacgacgagctccgtagcgaggtggggcgtcttggtttggcctcggagggccagctggaagaccctctgagatcaggctggcagcttgtatttgttgacagggaggacgatgtccttctggttggcgatgacccatggcaggaattcgtgaacagtgtgtcctgtataaagatactttcaccggaggaggtccagcggatgggaaagccgggcatccagctcctgagctcggctccttcaagaaggctgggcaatggctgcgacagctacgcgagcatgcaggagccgagaggcctggacgctgggatggcgccggtgggttcggtcgagttctgaagacggcggagggaagcccaccatggccctcgggtcgaggattactctccctcctgtatgtttctgcagcacttgctagctctgcgacttggaacaaagcacgtagatcaaatggagctctgtgctgctccccgtctgatgatgtcttatggtatagactcgtagcagtaactactacatgttgtatac

SEQ ID NO: 215 - DNA, 417 bp, Zea mays; identical to SEQ ID NO: 205

SEQ ID NO: 216 - DNA, 2407 bp, Zea mays; identical to SEQ ID NO: 206

SEQ ID NO: 217 - DNA, 1097 bp, Zea mays; identical to SEQ ID NO: 207

SEQ ID NO: 218 - DNA, 1001 bp, Zea mays; identical to SEQ ID NO: 208

SEQ ID NO: 219 - DNA, 707 bp, Zea mays; identical to SEQ ID NO: 209

SEQ ID NO: 220 - DNA, 722 bp, Zea mays; identical to SEQ ID NO: 210
  misc_feature (24)..(24): n is a, c, g, or t
  misc_feature (607)..(607): n is a, c, g, or t

SEQ ID NO: 221 - DNA, 721 bp, Zea mays; identical to SEQ ID NO: 211

SEQ ID NO: 222 - DNA, 1483 bp, Zea mays; identical to SEQ ID NO: 212

SEQ ID NO: 223 - DNA, 1272 bp, Zea mays; identical to SEQ ID NO: 213
  misc_feature (29)..(29): n is a, c, g, or t

SEQ ID NO: 224 - DNA, 696 bp, Zea mays; identical to SEQ ID NO: 214

SEQ ID NO: 225 - DNA, 1368 bp, Zea mays
atggagaggttgggcgtcggcgtcggcgtcggcgagctgccgccggggttccgcttccacccgacggacgaggagctgatcacctactacctcctctgcaaggccgtggacggcggcttctgcggcggccgcgccatcgcggagatcgacctgaacaagtgcgagccatgggagctcccgggtaaggcgaagatgggggagaaggagtggtacttctactgcctccgcgaccgcaagtacccgacgggcctgcgcaccaaccgcgccacggcggccggctactggaaggccaccggcaaggaccgcgaggtccgcagcggccgcagcggcgcgctggtgggcatgaagaagacgctcgtcttctaccggggccgcgcccccaggggccagaagacgcgctgggtcatgcacgagtaccgcctcgacggcacctacgcctaccatttccttcccggctctacgagggacgagtgggtgatcgcgagggtgttccagaagccaggcgaggtcccatgcggccgcaagcaccgcctgggcggccccagcgccgccgccggcgattcctgcttctcggactccaccacctcggcctccatcggcggcggcggcggaggaggagcgtccgcgtcgtctcgcccgctgctcaccgtcacggacacttcctcgccgtcgctgttcgtggccaacgcgaacgccgccgccagcaacaacaacggcaacccggtcaccgggcgagagctcgtgccctgcttctccactaccgccagtcccctggaagccgcggcgctcggcgtcgtcgggcacccgtacaacgcggccccgctgcgtctgggcttggacttcgaggcgccgtccccgggcttcgtcgtcccgaacctgcgttccctgcaagtgcaggacgacggcggcctgccgctgttcctctcggcagcagcaggcggcggcatgtcgtccgcgacgctgggaataatggggtcgctgggcgggtctctccactgcccgccccacgccggcatggatgtcgtcaaggtcgagggccgcgccgcgccgccgcagatggctgtcggccccggcctcctcgatggcgccttcgcctggggcttctagtgctcactgctcaggcgctgcacgccgccgtggcatatgggcatgcatgcatcaccagcaaaccgatggatatatatatgcctctccacatgcatgtggtagttcgtggtttctctgcatgcgttgtacgttaagcttcgttagtaagtggaagtggcagagagtcgtcgtttatgtacgctattaagcttgattagtatcaggatgtggctgaccgaccctccatgcatgggcactccaaactgtagcccttccagcagc

SEQ ID NO: 226 - DNA, 1259 bp, Zea mays
atggagcggttcggcctggacggcggcggtggcggtggcgagctgccgccggggttccggttccacccgacggacgaggagctcatcacctactacctcctccgcaaggccgtggacggcagcttctgcggccgcgccatcgcggagatcgacctgaacaagtgcgagccatgggagctcccgggtaaggcgaagatgggggagaaggagtggtacttctacagcctccgcgaccgcaagtacccgacgggcctgcgcaccaaccgcgccacggtggccggctactggaaggccaccggcaaggaccgcgagatccgcagcggccgcaccggcgcgctggtgggcatgaagaagacgctcgtcttctaccgcggccgcgcccccaagggacagaagacgcactgggtcatgcacgagtaccgcctcgagggcgcctacgcctaccatttcctccccagctccacaaggcaggacgagtgggtgatcgcgagggtgttccagaagcccggcgaggtcccacctgcagcccgcaagcaccgcctcggcgcccttagcagcactaccggcaccgccgcgggcgattcctgcttctcggactctacctcggcctccatcggcggcgcgtcgtcgtcatccacgcctggcccgctgttcgcgtcggcggccgccgccgtggccaatgccggcgccgccgacggcgacaccagctcctactgcggcggcgctgccaaccatggcaacctggtcaccggccgtgagctcgtgccctgcttctccactgccaccattaacggccccctagttgccgccgcgctcggcatcgggcagccgtacaacgcagccccgctgccgttcgagcagcagccgccgcctccggccttcctgccgagcctgcgttcccttcaggacaacctccagcttccaccgttcctctcagcaggcggtctgggcggcggcggggctctccactggctccccgccggcggcatggaggtcaaggtcgagggccgctcggcgccaccgcagatggctgtcggccccggccagctcgatggcgctttcggctggagcttctagttcttcgctgcactacatggttgtgcccatctatctagctagtagtggtttcttcatgcgttgtacgttaagcttggttaatcaactgctagtaagtgactgggtcgtcgttctaagtaatgtagtaactgtgttgtagtctctcatctaactgcagtagcagctttatttgttcgtggatt

SEQ ID NO: 227 - DNA, 1534 bp, Zea mays
gggcatccgcagaagttgaccacgtacagcagcggcagcgcgggctcctcctgttatataacgcccgcctctcgccgctctccagcttcttcttaatttctcttctatgatacaggggtaggagaaggaggaggaggagtagaagcagctccacacctgtacgtagctgccgcgcgccggtgagcgaggtcgttcttgagagctgtatatatatatatagctccgcgacgacgccgatgatggccatcaagtcgctgagcatggtggaggccagcctgcctccggggttcaggttccacccgcgcgacgacgagctcgtgctggactacctggccaagaagctcggcggcggcggaggccctgtggtggtgagcatctacggctgccccaccatggtcgacgtcgatctcaacaagtgcgagccctgggaccttcccgacatcgcgtgcattggtggaaaagagtggtatttctacagccttagagatagaaagtatgccactggccagcgtacaaacagagcaactgattcgggatactggaaggccacagggaaagaccgtccaataagccggaaagggttacttgttggtatgcgcaaaacccttgtgttttatcaaggtagagccccaaagggaaagaagaccgagtgggttatgcatgagtttcgcatggaagggcgagatgatcccatgaaattacctttcaaggaggactgggtcttgtgtagagttttctacaagagtagggcaacagttgcaaagccgcccacagagagcagcagcttcaatattgatgcagccacaacttcattgcctccccttattgacaacaacttcaatatctcctttgaccagcctggctcatcatcagtgcagaacctagagggttatgagcaagtgccctgcttctccagtaacccctctcagcagccatcgtcgtcgatgaacgccgcccggctgccgccgtctgccgccatggctgatccggagcagcagatggggaagtcaataatcaaggatgttctcatgagccagtttagcaggttcgaaggcagcgtcaagagggaggcgcctccaagcaatttttctcaggatgggtttgagtacttagctgagagtggcttcacgcagatgtggaattcgttcaattagttgattatgttttataggaagattatatatatattattgttatggagagcgatgcggatcgaaatgcctcgacgataacaggatggatatatagatgagtgctacaagaggcttgggtgtgtgtgcctcctgtgtggtattgcatgtagccgtagtagtagtaggtatatatatacatatagtagcagtaccatctcagtacacatccttcaaaaagaaggagaaatgaaaagagagatatatatatgtctgtatgccctatgccatcaattaatgacgacagatgtgtaaatacattatttgtgtactatggagaaatcagaaggaaaaaaatacagtgcgtacgtgatgacaaaaaacaagaatagaatcttattcat

SEQ ID NO: 228 - DNA, 957 bp, Zea mays
gaggatctggtaagcaactaagcaagtgtactgaggacggaggcatcgatccagcgttccagctagcacgcacgcagccagcacccagcacccagcagtagaatctatatatcgtacgcaagtagtggatcgaggcatctatctgcagtccctttcttcttcttcctcttgattgataggtgcgccgaagcttgttttgttgggtggcctttgtctctgtcgtctcgtctcgtctcgtcttccgcccggccgccaccacctgcaggctatactagctagctattaagtccggccaaccaagcagctcgatcaggtcggtcgacggcggggacagttcggagggaggaggcggccggagaccgaaggacgcctaccatcaactcgcggtcctggccgcgctgccgaaaaattaaaggaagaggacgaaggctgaccgatggacgatcgttatcctcatcatcagtcgtcgatggcgacaccggcagcagcgagcaagatgagcaagaagctgcagggcggtggtgaccgtagtagtggcagtagtagtaggggcagcggcaacagtgataagcagcaggtgccggcggcggcgatgaggaagggcccgtggacagaggaggaagacgctcagctggtatggttcgtccgcttgtttggtgaacgccggtgggatttcttagcaaaggtctcaggtttgcgcggtggcgggtgcatccgatccccaagcatgcatgcatgcatgcatatgtagatgcatgcgtgcgtggggatggattgatgtaggatgggctatggcgatgggtgttgattaaccatttcttttctctctctcttgtgcgtgccctgcttcttctctgtgcatgcgcatgtgtcggcggcgtactcgtgcaggtctgaggcgcaccggcaagagctgccgcctccgctgggtcaactacctccacccggggctccggc

SEQ ID NO: 229 - DNA, 1686 bp, Zea mays
tgcagctaggtccctcctctcaactctgcttcttcttcttccaactgatcatctcctaccttttcttttccaatccctaaacctacacacagctttacggtagctgctagtgctagtgcatggccatatatatgcatctataagtagataggttgcaccctccaaggggttcatatcatccaaggtgcatgccaggagacaggccacaataatgtcccagaggaaaggcgccatggcggctgcagtgacggccagcaagcatcgcgaggaccaggaggcgatgatggtggagctcaggagaggcccctggacgctcgaggaagacaacctcctcatgaactacattgcttgccacggcgagggccgctggaatctcctcgcccgctgctccgggttgaagaggaccggcaagagctgccggctcaggtggctcaactacctgaagcccgacatcaagcgcggcaacctgacgcctgaggagcagctgctcatcctcgagctccactccaagtgggggaacaggtggtcgaggatagcgcagcacctgccggggcgcaccgacaacgagatcaagaactactggcggacgcgcgtgcagaagcaggcgcggcagctgcgggtggacgccaacagcgccgtcttccgcgacgccgtccgctgctactggatgccgcgcctgctggagaagatggccgcgcaccaccacggcgacggcgagctgccgccgccactgcacccctcgcacaacatcgccggcacggcctcctcgcgctcgccgccggcccacggcagccagcaggaggacccgagtagtagcgcgccggcggccagcggccactacctgcagcaggtcgacccgagcccgagcacgtcgacgacgtccgggtcgacgacctcggccgcgctcccgccggtgccctgcttctccgaatccgaactaaggtgggtcgtggaccagtacggcgccgcttacggttacaccgacgacctcgacctcgacggcggcgccggcgtggtcgacgacgactcggctgccgccgccgcgctggacagcctcgggctggacgggctggacctggggcccggccgacggcggcgtgtactcggacgcgacgctgctggactacctcaacgccacgtgcgccggcggcaccaccgtgatgacaatgatgggcggcgtccacggcgccgcgggcggtggcgacggcgactacggtccgtcgccgtggcggacggacgagctcggccagacggcgaggaagctcggcgatcctcagcatcaatggagaggaggtatctagaagcaatcgagagagctaggtgagctagctcgctcgctcgctgctaaagcctagctagctacaaggatggtggatgatgctgatgatgggcgcaggttgcttcttgcgacgtctcactctcagctccccctccctctctcccaagcgatgatcgagatgtcacgccagttattaattgggattagcggcgatccaaagtcgatcttattaggtgacgttcccatcgatcgatcgatcgagacatctctgctgttaatttgttcgatcgatcgtggtttgtgtagcgcagatgtagtagtttgatggttgcgtgctgtcacttttatttattagtggggggtatgatcaattattcacgtacatatacatatttgttattcctccc

SEQ ID NO: 230 - DNA, 891 bp, Zea mays
  misc_feature (35)..(35): n is a, c, g, or t
  misc_feature (656)..(656): n is a, c, g, or t
  misc_feature (671)..(671): n is a, c, g, or t
  misc_feature (674)..(674): n is a, c, g, or t
  misc_feature (681)..(681): n is a, c, g, or t
  misc_feature (688)..(688): n is a, c, g, or t
  misc_feature (699)..(699): n is a, c, g, or t
  misc_feature (706)..(706): n is a, c, g, or t
  misc_feature (709)..(709): n is a, c, g, or t
  misc_feature (831)..(831): n is a, c, g, or t
attacagggtcgacccagcgtccgctagctgtcangagcgcaggagggggagcaaaaccgcgcggtgcgtatgccgctcagctcagctcagctcacccgctagctccggcatgcatgggcagctccggcgcgcgcggaggatggcgaggtgcgcgaggtggagaagcagggcacgtgcattcattcgttccatcgacggtctggcgccgactcacgcatcgccggcgcggcgagctgagcgcgcgacacggaagcaggtccgccgcgccggcggcgcccgctggccgatcgaccggctaactatagctagctccaggaagcaagccaggccagccagccagccgatcgatgcttgcgcgtgcatgtgcccttcttctccatcgggcacgcctcgcctgcgcatcttctgtgactgtgcatgcaagtaagcaaaaagacggtcaggatcaggtatcactggaagtggcgcatggtggatgttgcgctgtgctcgtgagaggtctaggtcatcgtctcccagttgacttctgcgccaaggacaatccttagttcgttttataattatcttttattttgtaataagacttccgctatgtaataaatactctgattattgtgacatttatctctatacactctgttattatatatgttgnctttcttgggcgcanttnaaaaaantttaacncttacaatttnggtggcnctnttaagggaaatgggcgacgaaaccccaataaaataatgggggccggccgctttaaaggatccaaacttacgtacgcctggcatggcaaattattatttttttttttagtggcaccctaaatnaaattaccgggccgccgttttcaaccgccggaatgtggaaaacccggggttacccaattt

SEQ ID NO: 231 - DNA, 1776 bp, Zea mays
tgatttttatcagctcgtcttccacctccgtccgtcgtacccatgtggttgagctcggcttcgagctcccattccccatgcgtcgtccgtcacctcgccctcggcgcgcgcctctgcttcctggtagccacgcccagcttcctctcttccgcgcgccccctgcttctccttggctagggcttcttcctcttcctgctcgccatggctggtcgagttttgccccagcctcagcgctgtgatttctccctccatctctactgcgcgtgctctggtcccagcgccgcgctcctttctcccatgctgcgtgccgtgctcctactgctccctgcgcgctgcggcccgctgctcctcccagccatggagctcgccagccggcgctcctccagtcgcccagcccagcaggagcttctcccatggccgtgacgccctggctcctgctctcctcatcacgcgcgcctgggcgctgccccaggtggccgtctgtcctcccgtatcgcctagctcgtgaaggctgccgagtccgaccccgccgtgagctccctggtgtcgcgtcccgaccaagctccctactcggcgtccgtctcctaactcgcgccctacttccatggccacacgcccatctctctgttcgcctctgcgcacagctccccaagctccatggccggttccctgctcgcgtcgtggtctcccagctcgtcagcacttgttcaagtcgtctcggctcactccgcctcaaattccagcgcctcgccctgctctcgtggttcagcgacggccggcgcgagcctgaccgtggtggtgtcgtggcgtggcgacgtcgtgcgcgtcgcgacagctgtcttggtcgtgaagtagtccgcgccatagagttcgctcgaccacggtctcgttaaactgcgaagcttcctcgccgtgcgctctagcatcggctgccgccgattccgccataaaattcacgagcgctccttgctcagtttgtttcgcagtgggcaatttctccacgtttcaattctgtgctgcttgccctgtgtgcgctcgctcctcatccaccgggcttcgacgtgttcgcgtttactgtcgagtcgtcgaacccgtcatcccctgctcgaccctcacctcaccagctcgctccagacttcaattgaaggtcgtcgtcgttccgtgcgtcgtcaagaagtcccaagcgtcgagtgaagacgaagctagccgcgtgatatttaccaagtgctcgacagaagacctgaacaagaatcagcaacgtttgcttggaattttaattgaatcggtaactgttctctagtttgctagttctttaattgattgagccgatttactatttttactattgattttatgatcgtaaaataagacgcttagtttgtgtatgaagtttaagttagaaatactcatgatgcgaggcgtgcttcgaggagtttagttgtcgagtatattcggactagttctattttgcagagtgtagtacttcaacgacgcgtaggttaaatttagtattttatgcaattatcgataaaactgtcgatgtagttgtattcagtgcgcgtaagatgaagtcgatgtcctgcgctagtagttagtatcatctatgtttgtgatcgataatgttggagtagaatatgatcgacgattttcttatttagtgattggtgtgatgtggtataatttataaagcgagggataagtttagaatttaattaattagctgataagttgtgttaggctaatcgtattaaatatatatagtttgtgttcaaaaaa

SEQ ID NO: 232 - DNA, 995 bp, Zea mays
attacatgcagtagaaattggtaagtaaatcacaatacctggaaggtgattgtgtgctaatctacttgctaagaaataaacactaattctgggcttactataacattccacctccgtctgtcgtacccgtgtggttgagctcggcttcgagctcccatcccccatgcgccgtccgtcacctcgtcctcggcgcgcgcctctgcttcctggtagccgcgcccagcttcctctcttccgcgcgccccctgcttctccttgaccggggcttcatcctctccctgctcgccatggctggtcgagcttttttccagccacgaagctcccatggccgccgagctcagcctttgctcctccctgcgtcgcgcgcctggcttgctctccagctcccgtgcacgcccggatcctcttcctcccaggggctcggccgcatctccatctcccagcaagcgccctaccgaagccctcccatggcgttgttcctccctggtgccgagtctctctctgccaatcgcccatggcgcccagccgcttggccttcctggtactcgctctccctcagtgccctgtcccttgtacgacgcccttcctgctccagtttgtatttttttatagctggccgttgttcacctcgccgtcatcgacctcccctcgccctcatcctctgcagggccagccctgagggtgtgcagggtatgccaccgctcagggcccccaatatccgtaggaccccgtatacctagataatgtccaaatacatatatgttacaggtaaatctctattctcgttttttgttatgtctctgattttttggcaattatctcttcgaggtcgtgcaacattttgctaatgacgaatactaaatattaattgatgcgggaaggtcggaaggtgttgtacatatgtgcttgtggcgttgctcaattctagcctaccggagggtccaccctgataaactacgttgtttaatccaggtttagtttgctgaaatttgttt

SEQ ID NO: 233 - DNA, 939 bp, Zea mays
taccaaccccgcgttgcggttatatagggccgtatttcccccgcgtctccgcgtcagtggaagcgatcgacaccattcaagctaaagctgctttcttgggaaacgcttgatcgcaacagctcgatcaatggcttcttcctggggttctcggttgccgctcgcagtagtgctgctgctcgtggcctgcttctcctccacggcagccgccacaagctacaccgtcggcgacgggtccggctggacaaccggcgtcgactacacatcttgggccgcctccaaaaacttcaaagtcggggacaatctcgtgttcatctacgcgaaagggctgcacacggtggtggatgtgagcgcgcccgagtacatggcgtgcacggccgccaactcgctgggctccgacagcagcggcgcgaccaccgtggccctcaggacgccaggcacccactacttcgtgtgcagcatcacggggcactgcggcgccgggatgaagctggcggtgaccctcggcggctccaactcccctgctgccacgccgcggacgtcgtccccgacccctaccacgccgtacacgacgccggccaccaccacgccgtacacgacgccgacgtgctctggcggcggcggcaccacggcgaccccgggcatgactccgttcacgtcataccccagcgcggccggccttgggtcggcggcgttggcttgatttagtctggtttggtgtgtgagtgtccggctagcgctgctctaggcaaagggcggccatggaccgtggtcgaccagggtatgtaacagtgtaacgtatgtgtttgttctttgttccggatcgagctagctggggtatagtatacttggacgaaggaagctgccaagctggtgactggtgtctcgactccactctaaatcgccgtgcaaccaaaccgtgcaagtcactttccttgaacc

SEQ ID NO: 234 - DNA, 622 bp, Zea mays
aaacataaacataaacgaccaataataccatagggatagggatgatattcatgtcactcgccgacacgacatatcagcagcacacacgtgtcctgcttctcttcatccatcggtgtcagccagcgatcaccatacatgaacaggggctttgacaaatcaattaaccacgattccgagaacctaaaatgggcgacctcatcagcagcttcacttttggacttgatgcctccctcgccttctatttaggcttctcatcaacgcctgacacttcaactcctcttctaggcggcagctccttctcatctacagattcatcctcacagatgttctcaccaaccccaattttcaactcttctgaggaacgaggatccaggaagtttacagcttcgttcagggcatgaacagccatcttcttgatctggaaaaaaaacatatccatcacatcggatagaccagatagatcactgcaagtgcacattgctaacctctagtttgtcttctttagccttgtggaaagatggaagtcgtctaaactcctccgtcagcttaacacactcaccaacattttctggggaaacaaaatcaagcgcaactttgatgcaggacttcaaatttctcactt

SEQ ID NO: 235 - DNA, 993 bp, Zea mays
cttaacaactccactcccgcggaaaaaaaacccatatccctccggcataaacccaaaaagccaggcagcaggagatggagcacgacgtgcaccaccagcaccagcaggccatggagctgccgccggggttccgattccaccccaccgacgaggagctcatcacgcactacctcgccaggaaggccgccgacgcccgcttcgccccgcgcgccgtcggcgaggccgacctcaacaagtgcgagccatgggacctgccatcccgggcgacgatgggcgagaaggagtggtacttcttctgcgtcaaggaccgcaagtacccgacggggctgaggacgaaccgggccaccgagtccggatactggaaggcgacgggcaaggacagggagatcttcaggagcaaggccctcgtcggcatgaagaagacgctcgtcttctacacggggagggcgcccaggggaggcaagaccggctgggtcatgcacgagtaccgcctccacggcaagcacgccagcagcagccgcctcatgccgtcgtcggtcagagctggcgcgtcaaaggacgagtgggtgctgtgcagggtgttcaagaagagcatcgagccgccgccgtcagtgggcaagaggtcgtcggtcgcgtgcacggggacgatggtggtggaggacgtcgtgggaccgccgtccatgtccatggaggacgacctcaccgcgtgcgcgctgcctccgctgatggacgtgtccggcggtggcggcgccaacatggcggcggcgtccatcgagctgctggcgccaccggcaccacacgtgacctgcttctccaacgcgctggagggccagttcttcctgaacccaccctgcctccacccctccacgtcgccgctccgcctggcgagcatggtgcaggcgcaggcgcagtacgacggcgacgcgggcatggtgctccagctcctgcaggaggccggcgggtggtacagcaagctgggcgagggggagcggc

SEQ ID NO: 236 - DNA, 1698 bp, Zea mays
caccagacacgccaaaagcgttattttaagggcggcgccaccactattgtcgcctgcttcaccctccctgctcactgccgcctaccctcgttgaagcgcgctctctcgctctcgctctcctcgcgcttcctcccactcccactggacagagaggagggttagtggagggcggggtaggaagctaccgccgccacagtaacagcgttagctaggggggaagcacggaagcgggaagcaatggcgaccggcggcggcagcagcaggagcgacgacgtgcgcgggctcaagtttggcaagaagatctacttcgagcaggacggcgggagcgggagcggggcgggggcggtgggcggcaggaaggggaagggcgtggccaccggtggcgcgaggccggcgtccgccgcctccgcagcccagccgccgaggtgccaggtggacgggtgcggcgtggatctgagcgccgtcaagcagtactactgccggcacaaggtgtgcaacatgcactccaaggagccgcgcgtcttcgtcgccggcatcgagcagcgcttctgccaacagtgcagcaggttccaccagctacatgaatttgaccaagggaaacgtagctgccgccgccgcctcatcggtcacaacgagcgccggaggaagccaccacctggacctctcacttcacgatatggccggctcgctgcatcacttcaagagcctggcaggttcagaagcttcctgctcgacttctcgtacccaagggttccaagcagcgtgagggatgcgtggccaggaatccagcacggtggcgacaggatgctgggcaccgtccagtggcatgggcaccaagaacctcctcacccacaccgcagtgcagctgctggctatggcaaccatgctgcatacaactgccatggcggcttggtagcaggcggggccccaatgctctcctctgccgcctttgagctcccgcctggcggatgtgtcgcgggagttgccgccgactccagctgtgctctctctcttctgtcaactcagccatgggacacgacctcccacgaccaccggtccccagcaatgcccgcggccggcgccttcgacggcaccccggtggcgccgtccgtcatggcgagcagctacgcggcgtcgagcgcctggacgggctcgcgggaccccgctgccgacggcgccaggaacgcgcagcgtctcgacgatgctctgcacctggtccacccaggctccgcggcggtccacttctccggcgagctcgagctcgccctgcagggaagcggcgggccgccacacctgccgcgcgtcgaccatggcggctccggcggcggcaccttcaaccattccaccaccagcgcgatgaactggtccctgtagcagcactgcctgccttcatccggtcgccacgccacgagatgtggagggagcacttttgcattggacaccaccctggttttgtgcgccttaccttgccgttctcgttttttcagggtggagaaactgggattcctaaccatagtagatctaccgtgaattcccttcccgtgtagtagcgcattgcgtccatgaactcatttgatcgatcgtcgtgtcaccgtgtgcgtaactgcgtatctgtttggcgtaactgcgtatctgtttgttgaatctttccgaacattgcggacttcccatgctgcttcaagcaacaactcgggctat

SEQ ID NO: 237 - DNA, 922 bp, Zea mays
ggaggcaaataggttttgtctggaataaagctcctgttagccatgtaaggcctttcacttttccatgggacagctcatctgagctccctcatgcaaaggaaataagagaggtgtcaacgaaagttgggacaattactggacaggttcatttggataaatcttacgtgtccaatgctgttccatcacttacccatggcaaagatgagccttggccaatgaaaggtccggacatgtctatagctgcttcaaaattcgatggagcaccggatcttcagcgtgctctctctcttctgtcagttggcgcctgcggattgcccgatcctgtacaccaaacatcttgcgtcatccaattcactagtgccagcgagaacagtggcgaccttcatctatcacatggagcgaactctggtctagcgtcatgcggtgatggacagcatatagcttttcagcctcaggctcagctggttcggtttaccatggataccagcaacagtgtctatgagcccagtttcttcagtgtaaaccagataaattaagcgttgaagacacacgccacttggtcatttggataaatagccctgaagatggcctgagcttgtgcaagaagtttttcaaccaacccccggacataaggatctatctgttaatgttatctgtgtatttattagccatacctgaattaagttgaacccaatctaggccagcttatgtgcaatatgcagttccaacctgtgattgacccattttttttgttgtttctttgcccgtgatgtgactgctttggaacttaagtgtgatactgttgtagttacactttactgccctgacaatcatgtcaaacggctggatatctttgaaactgtccttgatgaatctggacgtgtattttgtgtgtgtgtgtgtatatggttgtagcatcttc

SEQ ID NO: 238 - DNA, 884 bp, Zea mays
gcccgggccacgcgcagcaggcggcgccggcgtgctccgtgcagggctgcgacgccgacctgtcccagtgccgcgactaccacccggcgccacaaggtctgcgtggcgcactccaaggcgcccttcgtcaccgtcgccggccagcagcagcgcttctgccagcagtgcagcaggtttcatctgctcgaggagttcgacgaggtgaagcgaagctgcaggaagcgcctcgacggacacaaccggcgccgccgcaagccgcagccggaccctctcagccctgccggcttgtttggcgatcaccaccatggaggagtgacaaggttcacatcgtacccacaccgcttcaccacatccatcgcaaagcccgaatggggggcggtcgtcaagacggagaccgacgcgttccaagaccagtactaccctgccgtccacctcaacggcgccggcgccggcgccctcttccacgacaaggaccggaagcacctcccattcctgaccaaccacaacaatggatgccagccattcaccgtcaccacgacggcttcctcagagagcagcagcaagcacagcaacggcaactgtgctctctctcttctgtcagacaacccgacaccagcacaggcacagacggccacgatccctaccgcgcagcccctcgtcgccacggcatcgcagtacggcaggctccctggcggcgacgacgacgacgtctccctcgccgggatgtcgtacatgagggtgggagacagccggcaggcttccaatctgacaacgtcctcacccggtcctgccactgcagctgcaacacagcagcacctgcagtaccatctgggctgttgttgccctgctcgccaccgctcacatggtagtagtagccatggtgg

SEQ ID NO: 239 - DNA, 1531 bp, Zea mays
cccgtctcttcttctgcacagtccacactgttcacttccggccccctcccccgcacctccctccgatcccccaaatcccgaattgaccaacccaaagccgtcgccccgcatggagtggacggccccgaagcgcgccgcctcgccgccctcgcctccgctcctctgggactggggaggagaccacgccggcgccacgggctcgggctcgggctcctccggcgacgccccggcgcggcgcggcgggagggagcgggaggcgaagcgcgccagggccgacgacggcgaggtgaggtgccaggtggaggggtgcgggctggacctcagcagggtcaaggagtaccaccggaagcaccgcgtctgcgaggcccacaccaagtccccccgcgtcgtcgtcgccggtcaggagcggcgcttctgccagcagtgcagccgatttcatgccctgtcagagtttgatcagaagaagaggagctgcaggaggcgtctgtctgatcacaatgcccgccgccggaagcctcagccagatgcattcgcctttgcctctgcaaggctgccttcgtcgtcgttcgatgataggaggcaaataagttttgtctggaataaagctcctgttagccatcctttcacttctccatgggacagctcatctgagctccctcatgcaaaggaaataagagaggtgtcaacgaaagttgggacaattactggacaagttcatttggataaatcttacgtgtccaatgctgttccatcacttacccatggcaaagatgagccttggccaatgaaaggtccggacatgtctatagctgcttcaaaattcgatggagcaccggatcttcagcgtgctctctctcttctgtcagttggcgcctgcggattgcccgatcctgtacaccaaacatcttgcgtcatccaattcactagtgccagcgagaacagtggcgaccttcatctatcacatggagcgaactctggtctagcgtcatgcggtgatggacagcatatagcttctcagcctcaggctcagctggttcggtttaccatggataccagcaacagtgtctatgagcccagtttcttcagtgtaaaccagataaattaagcgttgaagacacacgccacttggtcatttggataaatagccctgaagatggcctgagcttgtgcaagaagttcttcaaccaaccaccggacataaggatctatctgttaatgttatctgtgtatttattagccatacctgaattaagttgaacccaatctaggccagcttatgtgcaatatgcagttccaacctgtgattgacccattttttctgttgtttctttgcccgtgatgtgactgctctggaacttaagtgtgatactgttgtagttacactttactgccctgacaatcatgtcaaacggctggatatctttgaaactgtccttgatgaatctggacgtgtattttgtgtgtgtgtatatggtttttgcttcttcaatgtttgtccaaggaatatagatatataaaaagctgttgcatc

SEQ ID NO: 240 - DNA, 1567 bp, Zea mays
tggctgcctgctcctccccgggaggctcgtctcgctgcccggttgctttatatggggtgccacgccacgccagcgtgggtagcataccggctgtacttccagcagcagcatcatcagccgccgccgccgccgccgcgcttccactttgtcttgagccctgccctcaacgacgactcgcgggccggcagcacagcacgtatagctatggaaggaaacggtggcgcgggcggcggtagcggaagcgcggcaccgccctgggatctcgccatgcactgggcacccgccgtagtgtcgtcctacccgccgcagcccttggagctgcagcagcaggagcttacctgcctcaagctggggaagcggcccgcctgctgctgggcaggggcgccgggcaaccaagcggcgcaggtccacggcaatggcggcgctggtggcgcagctgctgagggtaagaggaaggacaaggcgcctgccgcggcggccgtgacgaggtgccaggtggaggggtgccacctgtcgctggcggacgccaaggagtaccaccggcggcacaaggtgtgcgaggcgcactccaaggcgccccgggtcgtcgtcctcggcgccgagcagcgcttctgccagcagtgcagccggttccacgcgatctcggagttcgacgacgcgaagcggagctgccgacggcgtctggccgggcacaacgagcggcggcggaagagcaacgccagcgaggccatggcaagaggcgtcgcgcacccacacggagtgacggctttcggccacggcggcttcctgccctcgcgcggcctcgtccccgcagggtcgtccccggcggcggctggtgctctctctcttctgtcatcggccagaggcagcgtggcgggcgccagcgggccctggctggtcacggcggcgcgggaggacatcccggcgcgctccagcgcggcgctcgacgaccttatcgccgagaaccgcgccgccgcgctcctcgcgcggcagtacttcgtctccgaccgctcgccggcgcccagacgggatttcgtcgcctcttcgacggcgggttgctccctccagcagcagcagcacccgcccgaccacgaccacacagccggctggcacccgcacccccacccctacagtggcggtggcggtggcagctgtggtggtcggtaccagtaccaccacgtggcgccgccgagcgcgtggcacgcgacgacgctggaccttatgcagccgacagcaagcaccaccgccgctcccgccaccgccggcgcagcgttgtggccagcagtgccggagagggcgggcgcgaggtcgtctcgctctcgcagcgagaccaaggatggcgacgcgtcgggatgtagcggcttggacgcgtgggcgcccactggtggagctcgtgtgctgtgatcgccacgcgatcgacgagcgtgacggccattatatatgttgcgcctgtagtggtcgatcgggtgttgcgtggtgcctgatgtcccaaaagggatgtgtaatccaatgtacttcgggatgtgctttttttttggtaatgaatcatgtttttctcaaaaaaaac

SEQ ID NO: 241 - DNA, 2005 bp, Zea mays
tacctaccagccaaaccaagcaagcagggaatccccacaaggcagcagatggaagcgaaaggtggcggtggcgcggcgtggcgcgggcgcgggcgcggctagctaggccggctcgtgtgcgtgcgcgaggagacagccacagccatacagggatgctgcctgcttcgtgaccgtgctggtggtggtgggctgcagcctgcagctcgtatcacacgcccacagtgcaggaaggagggagtggaagaagagagaggaagttgtttttaaaggcaacagcgagtcccgctgctgtccctctccttcgccacctccctccctcactctcttccctccctctcggaggaggagagagaagagagggagccagtccagctccagccagccggacgcccggaccaacaccaccccgcctccccctccccccgccccaccggcccgccctctcgcgctgccgtacccacggccccacgcacgttcacaagtctcgtcgccgccgcaatggagtccggcggtggcggggacgaccagctgcacggcctcaagttcggcaagaagatctacttcgaggacgccgccggctccagcagcggcagcagcagcggcggtggcagcgcgcccgcgcctccagcgacgcagcagccgtcgccgccggccgcttcgcctagggccccggccggcggcggcaggaggggcagggccgcggccggcggcgcgggcccctcgacggcgcccgcgcccgcgcgctgccaggtcgacggctgcaacgttgacctcaccgacgtcaagcccgcctactactgccgccacaaggtgtgcaaaatgcactccaaggagccccgcgtcctcgtcaacggcctcgagcagcgcttctgccagcagtgcagcaggttccaccagctgcctgaattcgaccagctaaagaagagctgccgcaaacgcctcgcaggccacaacgagcgccggaggaggccgccgcctggaccccttgcgtcacgatacggccgtcacgctgcgtcgctcggcgagcccggcaggctcagaagcttcatgctggatttctcgtacccgagggtctcaagcgccatgaggggtgggtttccggcggtgaggcccggtggtgaaagggtgcctggcggtatccagtggcaagcgggcttggatcctcgtcaccaccaaggcgcggtcgcgggatacggcgcccactatgggagcgagggtggtagctcgtcgtcggcgaggccgccggtgttccctggcccggagctgcccccaggtggatgccttgcaggagtccccgcggactccagctgtgctctctctcttctgtcaactcagccatgggatgctgcccacagccacagccacagccacgctgcgccaacagcgggtttcgacggcggcagccctgtggcgccctccctcatggcggcgagtagctacatcgcgccgagcccctggaccgagaccgactcctggggccacgaaggcgggcggagcgtgcctcagctgccacctgacgacgtccccctcggcgaggtgcactccggctcgagcagccaccacggccagttctcaggtgagctcgagctcgccctgcagggaaacaggccagcgccagggtcggcggcaccgccagcgccgcgcaataatcagggctccgcgggcacgttcgaccaggctggcaacacgatggactggtcgctctaggccgggggccgaaataaagcgcagcagatcctagccgcgcagggagatggaggaggctgaaagtctgatgctgcacgctgcttgcttagcttagagcatccagcatgataagagtgatgaactgatgcggtgtcaggagactagtttattctgtgcttcaccatgaactcgtctgtcgcggcgtctatgtagacagacggcacacgtccgtggttcgaagttaccagtatgcttgtcggggactttgctcgcgatgcattaatctcattgttcaccatccagaaatctcatgttctct

SEQ ID NO: 242 - DNA, 945 bp, Zea mays
caacctgaagcactttcttttgggtcatcaaggctgtcggcaatgttctatgacacaagacaacacacaagccttctgtttggtcaaggtccttatggtcaaatgagaagttgtgcaagttcttcatgggataaccctggaggtggcttcaaatttgcagagacaaaaggtccctggttaagagctggtggtgttgatgggttgcatcaaccaagtcagcaggtgtggaacaactttatgccacatggtgtccatcaagattttgatgggttcacagctttcaaaggaaccaatgcaaaggtccttcatcaaggcgttgaagcttctgcggtcgcctccaaccagaacggcgccccacaaccggaccttcatcgtgctctctctcttctgtcaaacagctgggctggtggtggtaccggtaccggtaccgaccagcacccgacggcccagctgcgccacgctgccctgagcagcagcctcgccgccagctccgtctccgtggcgcaggcctcgccagcagggctgtggcaggacggcggcgcggccctgggccaccacgactacgcccacgcgttccaggctatcaacacgccgggcggcggcggcgccgccgctcccattgcagtgggtcaggagctgcttcagctcccgcgtccgccgtccctgtacgacgacggctcctcgtcccgctacgacctgatgcgctgaaccttggggcttctggtggagcgcggggtttcgatttttgaacgaactctggatggaactcggagttttgaacgaactgctgtatgcttgctatcaaggtctgctggctcgggctcggacgctcgtgggatcgccagcagctccgtgtgcttgaataaatccacagtttttttttgtgtgacgctagctatttatttatttcacttgtgtaatgtgatgcgagtatgcgactccctc

SEQ ID NO: 243 - DNA, 785 bp, Zea mays
gggggcgtcaatgctctcctctgccttcgagcccccgcctggcggtggcggatgtgtcgcaggagctaccgcggccgactccagctgtgctctctctcttctgtcaactcagccatgggatacgcccacccaaagtggcagcagccaccacaaccggtccccagcgatgtccgcggctgcaggcgccttcgaagtggcgccgtcgtccgtcgtggcgagcagctacacggcgtcgagctcctggtctggctcacgggaccctgccgacggcgccaggaaaaacgcgcagcgtcacgatgatggcctgcacctggtccatccaccaggccccgtccaccacggccacttttccggcgagctcgagctcgccctgcagggaagcggcccgccgcatgtcgaccatggcggcggcacctgcttcagccattctgacaccaacgcgatgaattggtccctgtagggacaacaacttttgccgccactgccttgatccggtcggcacgccacgagacatggagcacttgggattgggacaccctggttttgtgcccctgaccttgccgttctggtttttcagggtggaactaactgggattccctaggcgtagatcatgaatcccctttccccgtgtaacccattgcgtccatgaagtcggcccaacaccggatcatatataattctacaactcccataacctaaatcattcttcagttgtgaagatatatgcttgtcaagtgacctggttttattttatctgccatcaattcatcatcatcacttcttt

SEQ ID NO: 244 - DNA, 1240 bp, Zea mays
cacagtcctatttttgaatttgaaatatttctggccccccgtcagccttaccctgttcagcatcagtggtgtggtagtccgggctcctcctgagagaataatacttctgttttgaatttgaaatttgtttgatcaggtttcacttgctcgcggagtttgacgaggccaagcgcagctgtagaaagaggctcgatgggcacaaccggcgtcgcaggaagccgcagccagataccatgagctctgggagctttatgacgagtcaacaagggacgaggttctcgtcgttcccggttccaaggccggagccgagctggcccggagtcatcaaatccgaggacagcggctcatactacgcgcaccagcgccacccggtcctaagcagcaggccgcacttcgccggcgggggctccacgccgccggcctactcgtccaaggaaggccggcgcttcccgttcctccaggacggctgcgaccagcagcaggtcggcggcttcagcgcgggcgcgggggcgcagcagctcgaggtctcttccacgtccacggtgtgccagcccctcctcaaggccgccgccgccgccgccccaccgccgccgccagagagcagcagcagcaacaagatgttctccgacgggctcgcccccgccgtgctcgactcggattgtgctctctctcttctgtcatcccccgccaactcctccagcgtcgacgtgggccggatggtcgtccaccagcccgcggagcacatccccatggcgcagcccctcgtccccggcggcctccagcagcagcagcagcaccacccgttcggcggctcccccgcctggttcgcctgctcccaggccggctccagcgccgtctccgccggcggtttcgcctgccccccgggcgtggagagcgagcagctcaacaccgtgctggtgccgagctccgacggtggcggccacgacatgaacatgaactaccacggcatattccacgtcggcggcgacggctcctccgacgggacgtccccttcgctcccgttctcgtggcagtagctagctttccaattcaagcgtccagcagtctatcgtttcagctgtactagtggtcgttttatttatttattcgctgctccctcgctccgttttaacttgtcctgtcgtttgctcgtttcttcgttttgcatgcctgatgcatatgcggcctggaaaaaaaactcgcataaaattactgagaccgtccgtgtgtctggttttgg

SEQ ID NO: 245 - DNA, 1024 bp, Zea mays
gatttgcggcccttccagtcttccaccatgttcatttcttttccctatcctcatctgtacactcgtctacacaaccagctttacttcagtacaactacaacaacgacgacgacgacgtcatctatccacgtggcaagggatgtggtacaagtggtgcacaggcaccagaccctgtgctgccttactcttcttacacaggactatcgtcaggcatttctcttggtctttgcttcctccctcacacgatctctcctcgacggctaacccggattgccgtctcaggctcgggatccgggcgctcgcggcgatggacggcggcggcggcgctggcggcgcggagggggagctcacggcgcaggagacagcgctctacgaccgccagatccgcgtctggggcgtcgatgcccagaagagactaagtaaggcgcacgtgcttgtgtgtggcatgaacggaaccaccatcgagttctgcaagaatattgttctagctggagttggaagtttatccttgatggatgataatgtagtcacagaggaggatctgaatgcaaatttcctaattcctcctgatgagagcatatatggtggtagatctcgagcccaagtttgctgcgagtctttgatagatttcaatcctatggttcgagtttctgttgaaaagggtgatccatcattaattgatggagaattccttgacaagtttgacattgttgtacttagccgtgcatctcttaaaacaaagttgttgattaatgaaaactgtcgaaagagaagcaaacacattgcattttatactatagattgcaaggattcatgtggtgaaatatttgttgacttacagaagcatagctatgttcagaaaaagcctggaggagcaactgaacaacaggagttgacatattctagccttcaggtagatgatttagttttcagtgacttctaaaatctaaagtctggtaaaattattttgactcaaacataccttgttcatgttttgctccctgaatatagtgttctttttggc

SEQ ID NO: 246 - DNA, 610 bp, Zea mays
gacaaacagcagccgcaaatcttacggcccttccagtcttccatcatgttcatttcttttccctatcctcatctggacactcgtctacacaacagctttacttcagtacaactacaacaacaacgacgatggagggatggggtacaatgctaggcctttgggatcgagcgcgacgagaccccgtgcaagagcttgatgaaccccaggaagctcagcttcccgtcggcgtgtctgacccagtcttggaggacaacggggagaggcactgacgggccaagtccgagctcctggcaaaccacaaaaaacgaacatgagcgatgttcagcgagcagctaataccatgccatgcatggccaccagttgcctgaacagatggggtcgtactcataccgacgcaagttcctcgatcacaatgggccggtttccttccttgtcgaacagctcgtacgcgcgcctcgcgtgctgctcccaggtctccagggcttccatctgggagacgctgatgggggaagcggcgaactcttcgaaatccagtttcctgtactgaagagcgcacacctagagcatcgtgacaggcacccccccccccccgtgagggggttgggattat

SEQ ID NO: 247 - DNA, 1631 bp, Zea mays
gtccccgcgtgcgtgacgctgacggccgcatccgccggatccatcgtccacctgacaaaaccccgcccccgctaggcggctgagcttcccttccactctctcttcccctgcagcctgcagctaagctaatccacccccacccccgagctgaatcgcccctcttcccctttctatcctcatcctccccccgctgccgcgagctcaacctgtgcatggtcgtcgcagcaacagctccatgaaggtgctctgctccgcgtgcgaggcggccgaggcgcgcctgctctgctgcgccgacgaggctgccctctgcgcgcgctgcgaccgcgacgtgcacgccgccaaccgcctcgccggcaagcaccaccgcctgccgctcctcccgcccgacgacgtctccgcgcccaactgcgacatatgccaggaggcccacgcctacttcttctgcgtggaggaccgcgcgctgctctgccgggcctgcgacatggccgtgcacacggccaacgccttcgtctccgcgcaccgcaggttcctcctcaccggcgtccaggtcggcctgcagcccgccgccgcggcccaggacgcagacccgcacccgcccgccgccgcggaacccctccagacgcccccgccgcccgacaggaaggcggcggcggccggcgacggcagcagcccggcgctgctctacagcgacgacgacatcgactgggcggccggcgcggacgccggcggcggcgtcagcgtcgccgtcaccctgccggactggtcgctcgtccacgagcagttcggcgccccgccggtggtgccccgacacgcggacccggcgctagccagaacgccctcttccaagcgcagtccccggcggtcggtcgccgcggcgttcaccgtccagggcggcggcggccttgcagggggcttgccggactggccgctcgacgagttctttggcttctccgagtacagcgccggcctcgccttcgctgagaatgacacgtccaaggccgacagcgggaagctcgggagcaccgacggctcgccggccggccggccgtcgtccgacgcgtcccaggacttcttcgggcaggtgccggagttccaccagtggtccgtgccggagctcccttccccgcccacggcctcggggctccactggcagggcggcccgcgccacggcgcggccaccaccaccgacgtggccgccgtgttcgtgccggacatctcgtccccggagaaccccttctggtgctacgccaccgccgctggccaggcgccgacgaagcgccgcaggagatgttgaagtagggaagatcgagattgtcttgttcagtactggagtggcgtaggcttgcaagaaacaaacacagttgctgtactgtactcccatggtgacgtactatctatatactccatatcgcagcagcgtagctcgtagggaagtgcggagctagagtggttaattagggctactctactactaccattgtattttttttgttgctgttgacgatgattaattaggacgcctaatatgtagtacggggtaggttggttgtgtgttagcttggcgcgtgctatcagagaattgatgagaaaaaggtaagatggaaataaagaaaacgattgttgtgcaaaag

SEQ ID NO: 248 - DNA, 703 bp, Zea mays
cgcgtgcgtgacgctgacggccgcatccgccggatccatcgtccacctgacaaaaccccgcccccgctaggcggctgagcttcccttccactctctcttcccctgcagcctgcagctaagctaatccacccccacccccgagctgaatcgcccctcttcccctttctatcctcatcctccccccgctgccgcgagctcaacctgtgcatggtcgtcgcagcaacagctccatgaaggtgctctgctccgcgtgcgaggcggccgaggcgcgcctgctctgctgcgccgacgaggctgccctctgcgcgcgctgcgaccgcgacgtgcacgccgccaaccgcctcgccggcaagcaccaccgcctgccgctcctcccgcccgacgacgtctccgcgcccaactgcgacatatgccaggtacgtgtagcgcctctgtggtacacacacacacaaaagaagatattttgctgccctgccctgcgcaccgacggctgacgactcccctcctgccggctctccaggaggcccacgcctacttcttctgcgtggaggaccgcgcgctgctctgccgggcctgcgacatggccgtgcacacggccaacgccttcgtctccgcgcaccgcaggttcctcctcaccggcgtccaggtcggcctgcagcccgccgccgcggcccaggacgcagacccgcacccgcccgccgcc

SEQ ID NO: 249 - DNA, 801 bp, Zea mays
ctgcagcctgcagctaagctaatccacccccacccccgagctgaatcgcccctcttcccctttctatcctcatcctccccccgctgccgcgagctcaacctgtgcatggtcgtcgcagcaacagctccatgaaggtgctctgctccgcgtgcgaggcggccgaggcgcgcctgctctgctgcgccgacgaggctgcccacccccgagctgaatcgcccctcttcccctttctatcctcatcctccccccgctgccgcgagctcaacctgtgcatggtcgtcgcagcaacagctccatgaaggtgctctgctccgcgtgcgaggcggccgaggcgcgcctgctctgctgcgccgacgaggctgccctctgcgcgcgctgcgaccgcgacgtgcacgccgccaaccgcctcgccggcaagcaccaccgcctgccgctcctcccgcccgacgacgtctccgcgcccaactgcgacatatgccaggaggcccacgcctacttcttctgcgtggaggaccgcgcgctgctctgccgggcctgcgacatggccgtgcacacggccaacgccttcgtctccgcgcaccgcaggttcctcctcaccggcgtccaggtcggcctgcagcccgccgccgcggcccaggacgcagacccgcacccgcccgccgccgcggaacccctccagacgcccccgccgcccgacaggaaggcggcggcggccggcgacggcagcagcccggcgctgctctacagcgacgacgacatcgactgggcgggcggcgcggacgccggcggcggcgtcagcgt

SEQ ID NO: 250 - DNA, 578 bp, Zea mays
ctcgtggatgacgctgactatcacatccacgaggatccatcgacgaactgacaaaaccccgcccccgcgaggcggctgagcttcccttccactctctcttcccctgcagcctgcagctaatctaatccacccccacccccgagctgaatcgcccctcttcccctttctatcctcatcctccccccgctgccgcgagctaaacctgtgcatggtcgtcgcagcaacagctccatgaaggtgctctgctccgcgtgcgaggcggccgaggcgcgcctgctctgctgcgccgacgaggctgccctctgcgcgcgctgcgaccgcgacgtgcacgccgccaaccgcctcgccggcaagcaccaccgcctgccgctcctcccgcccgacgacgtctccgcgcccaactgcgacatatgccaggaggcccacgcctacttcttctgcgtggaggaccgcgcgctgctctgccgggcctgcgacatggccgtgcacacggccaacgccttcgtctccgcgcaccgcaggttcctcctcaccggcgtccaggtcggcctgcagcccgccgccgcggcccaggacgc

SEQ ID NO: 251 - DNA, 662 bp, Zea mays
acagaagcgccccaagaagcagcagcgcaggagcgagcgatcgctatggctcagggaagaggcagtgcgacgcgggggcttgccctcggcgccctactcgccgccgctttcctcctcctcctcggcgtcgccgacgcggccacccacagggtcgactggtccttcaacgcggacagctggtccaagggcaagagcttccgtgccggcgacgtcctcgagttcaactacgacccctccgtgcacaacgtggtggccgtggacgccggcggctacaacggctgccggccctccggcacgtcgtacggctccgggagcgaccgcatcacgctcggccccggcaccagctacttcatctgcagcctcaacgggcactgcgggatggggatgaagatggtcgtcaacgccagctgagcacgacgcttatatgttagtactgcaaaaatatatgggctagtggtggtccgatagatcgtgcaagaactcaatcgtgtggcatactcgtaccgtgtgttcgatggacacggttcatgtgttgtgtatgcatgcgactgctggtaggtcaggcatgatgtacgtgtggctgatggcgtgttagtaaagcgtcctgcagctttgttgttactttgttcgatcgaagcagcggcttcttttgtttgttcatc

SEQ ID NO: 252 - DNA, 831 bp, Zea mays
caccacgatcgataaagctaattaagctgctactgctacgctagcctcgatcgatcaagcaagcagctcacagacccaccggcccacccacccacccacatggcggcgtcccgttccgctctgatcacgctgctcgtccttgtgagctccgtcgcggcggcctcggcgaccacgttcaccgtcggcgacagtagcggctggagtcgtagcgtcaactacgacaactgggccagtggcaagaccttcacggatggagatcagctagtgttcaacttcgccaccgggaaccacgacgtggtggaggtggacaagagcggatacgacggctgctccaccaccaacgccgccaacacaatccaaaacggccccgccaccgtcaacctcacctccggcacccactactacatctgcggcatcagcggccactgcagcggcgggatgaagctcgctgtcaccgtcggctccggctccggctccggctccgggtcccccacccccggcggcggctcgcccagcacacccacaccaaccaccccgagcgcccccgcccccgacactccggccggcgcgtccgtgcgcctcacggccggcccagcgctcgccgtggccgccaccgtgctcgtcgccctcttctgatctgatctgatacttcatgcatgcaccgtgccaggaccaggatagaggcagtgcaggattatagtattcttgtgtacgtacgtacatactttgttgttgagctagcgttttcattctgacgacggcggattattgtactctcgtacgtttttatttccacatgtattactactatcattcatgctttcaaaaaaa

SEQ ID NO: 253 - DNA, 612 bp, Zea mays
ggttcaacttcttccccggaaaccccgacttggtggaggtggacaagagcggataggacggctgctccaccaccaacgccgccaacacaatccaaaacggccccgccactgtcaacctcacttccggcacccattactacatttgcggcttcaccggccactgcagcgccgggatgaagctcgctgtcaccgtcggctccggctccggctccgggtcccccacccccggcggcggttcgcccagcacacccacaccaaccaccccgagcgcccccacccccgacactccggccagcgcgtccgtgcgcctcacggccggcccagcgctcgccgtggccgccaccgtgctcgtcgccctcttctgatctgatctgatctgatactgcatgcatgcaccgtgccaggaccaggatagaggcagtgcaggatcatagtattcttgtgtacgtacgtacatactttgttgttgagctagcgttttcattctgacgacggcggattattgtactctcgtacgtttttatttccacatgtactactgtctatcattcatgcttccaattcttcattgttaatttgttgcctgtggtgtgtatcatcatatattcatac

SEQ ID NO: 254 - DNA, 1655 bp, Zea mays
cgacgttaggaagtccggagacgccgacgggttcttcacctcccgcgtgcgcgcgcacggctccaccgtggtgcggctcaacatgccgccgggccccttcgtggcgcgcgacccgcgcgtggtggcgctcctcgacgccgcctcgttcccggtgctcttcgacacctcgctcgtcgacaagacggacctcttcacgggaaccttcatgccgtccaccgagctcaccggcggctaccgcgtgctctcgtacctcgaccccgccgagcccaaccacgggccgctcaagacgctcctcttctacctcctgtcgcaccggcggcagcacgtgatccccaagttccgcgaggtgtacggcgacctcttcggcctcatggagaacgagctcgccagggtcggcaaggccgacttcggccactacaacgacgccgccgccttctccttcctctgccaggcgctgctggggcgcgaccccgccgagtccgcgctccagggcgacgggcccaagctgatcaccaagtgggtgctgttccagctcagcccgctgctcagcctcggcctgcccaagcacgtggaggactccctgctccactcgttccgcctcccgccggcgctggtcaagaaggactacgaccggctggccgacttcttccgcgacgcggccaggagggtggtcgacgagggagagcgcctcggggtcgcgcgggaggaggcggtgcacaacatcctcttcgccatgtgcttcaactccttcggcggcatgaagatcctgttcccgtcgctcgtcaagtggctgggccgcgccggcgggcgcgcgcacggccggctggcgacggaggtacgcgacgccgtgcgcgcgcacggcggcgaggtgactatgaaggcgctggcggagatgccgctggtgaagtcggccgtgtacgaggcgctgcgcatcgagccccccgtggcgatgcagtacggccgcgccaagcaggacatggtggtggagagccacgactatggcttcgaggtgcgcgagggggagatgctcttcggctaccagcccatggccaccaaggacccgcgcgtcttcgcgcgcgccgaggagtacgtgcccgacaggttcctcggcgaggacggcgcgcagctgctccgccacgtcgtctggtccaacggccccgagacggcgtcgcccacgctgcaagacaagcagtgcgctggcaaggacttcgtcgtgctcatcgctcgcctcctcgtcgccgagctcttcctccgctacgactcctttgacgtccaggtcggcgcctccgcgctggggtcgtcggtgaccatcccctcgctcaagaaagccaccttctgagctttgatggaccgcccgtcaaattcgccggaggctggcacgtgcacttttttttccccgtagaatatactgcatcgtacttgttctgcccccatccctctcaatatttttttagcgctttgatgtgatcatcaggtataacaaaatgcctatttttagtaaaacgagagcccgtttttttttcaggcaaatttgatagcgaactgagggagacatgcccatactgttcatgttgcttaggtactgttcggttattcctgtaggagaggggattgagaaaatttgtaaaaggttttcaacggatttaaacctatcg

SEQ ID NO: 255 - DNA, 174 bp, Zea mays
tcgccgggctcgccctgatgggctaggctaggcaagaggcagtgctgtttcggttttccttatgtcccctgcttttcctgttggttgcagccctgtagcccattgtgtttactgtctacgcaccctcctccattcacgtttatgctcacgatggcttgttcgaggctcctgctg

SEQ ID NO: 256 - DNA, 1886 bp, Zea mays
atggacgcctgcagtccggtccggaattccctcaacaaacgggcgtccgctggaagttttccacattttccggggcacgccgcgccggcatttgctcaccacgggatggagcgctttcgccaaccagaagaagctcgtcgccggggactccatcgtcttcctgcgcaccgagcatggcgagctgtgcgtcgggatacgccgtgccaagcgggtgtcctgtggtggcatggagtgcatctctggctggaacgccccggtgtacggggccttgtcggcgttcttgaaggacgaggaaggtaagatcactaagggtcctggtgggtacatgagaggcagggggaaggtggagatcacggacgttgttgaggccgcaagcttagccgcgagcgggcagccatttgaggtggtgtactacccgagagctagcactccagagtttgttgtgaaggctgcatcggtacagaacgcgatgaggaaccagtggtgccctgggatgaggttcaagatggcatttgagacagaggattcgtcaaggatcagctggtttatggggacgatagcttctgctcaggttgctgacccaatcagatggccaaattcaccgtggaggcttcttcaggtgtcatgggatgaaccagacttgctgcagaatgtgaaatgtgtcaatccatggcttgtggagattgtatcaagcattccaccgattcacctagggacattttctccacctagaaagaagttgcgggtggcccaacatccagactttccatttgagggtcagctgttgaatccaattttccatgggcaacccactttggtccaagcaacagcccacttcgctgtttctcggacatcgctcctgcaggcatacagggagccaggcatgctcaatttggtttacccctaacagactaccagcttaaccagctgcacctcggtttcaaccggcttggtgctatgactccgacgccccgtatatccaagggttttgtgatcagcagcgcaccagccagtgagagtgtctcttgcttgctgacaatcggcacaccacaggccacagagaaatctgatgacataaagagaccccacataatgctgttcggaaagcctatccttactgagcagcagatggattctggaggatcgagggaaggcctatcccaagaccgcaaggcttctgagcttgggctagaagacgggcactgcaaggtgtttatggaatcagaggatgttggccgcaccattgacctatctgtctttggttcgtacgaagagctgtacggccagttagcggacatgtttggaattgagaaggcggaaataatgaggcacctttgctaccgtgatgctgctggtgctgtcaggcatactggtgaagagccgttcaatgacttcatgaaagtagcacggaggctcaccattatagagggcacggaggggagaccgcagaaacctctcgtggaatacatggtcgagcgggcttgattgcatggtggttcggacaaggcaatctgaaacttgtgcaagactgagcttagagcgaagtaactgctgtgtgttttcatttgtgtttgtctgccgccgaagcagaatcgcgatgcttgtctggtcgtgtggaaaaccttggtgtacgcttcgtgacttggtcgttagaactctgtcgtggtcagttgtgttttgcttggtcgaagttgatgaataacctctttgacgaattagcttggaataaagttcgagttgttgtgttatggtaagtgccatggcaacatggcaattcagttgtcactgtcgatttagttaaaatgcgtgtatctgttattacagtttgacaacacttattcatttcatcagcatacttgtggccggttatctatcgccagtttggg

SEQ ID NO: 257 - DNA, 1499 bp, Zea mays
agggtgctggtgcggccggaggaggtcgtcgaggccgccaacctcgcggcgagcgggcagccgttcgaggtggtctactacccgagggcgagcacgccggagttctgcgtcaaggcgggggcggtccgcgcggccatgcgcacccagtggtgcgccgggatgaggttcaagatggccttcgagacggaggactcgtccaggatcagctggttcatgggcactgtcgccgccgtgcaggtcgctgaccccatccgatggcccaattcaccctggaggcttcttcaggtcgcttgggatgaaccggacttgttacagaacgtgaagagagtgagcccatggctggtcgagcttgtctcaagcacgccggccatccaccacctcacgccgttctcgccgccaagcaggaagaagctgtgtatcccattgtacccggagggccaccagctcccggcgccgatgttccacggaagccctctggtgggccgtggtgttggcccgatgcgctacttcccggacggcggcactcctcctgcaggcatacagggagccaggcatgcgcaattcggcatatctttaccagatctccaccacctcaccaggctgcagtcgagtctatcgccgcacgcgcacgggcttcgccaccagctcgaccacggcgcgcggccgaggatcgccggcggcctcatcgtcggccacccggcagctcgggacgacatctcgtgcttgctcaccattggcaccgccccgcacaagaaaccatcagacgtcaagtcggccgcggcggcgccggcgccgcagctgatgctgtttgggaaaccgattctcaccgagcagcagatatctctaggctttcggccgctgccggcgccgaagaagagcccgtccgacgacgctgctgagactgagaggacggtgagcaacaactcggatgcctcgagcccagctgggactgcgagtgggagcacgccgtccatcagtggaggcgccccgtcgtcgtgccaggacaacaaggcggcggcgacggcgacggcgactgatgacgacgatctcctcgggcactgcaaggtgttcatgcagtcggaggacgtcgggcgcacgctcgacctctcggctgtcgcgtcgtacgaggagctctaccagaggctggccgacatgttcggcgtcgacagggccgagctgacgagccatgtcttctaccgcgacggcgcttctggagcgctcaagcacgccggcgacgagcctttcagtgagttcaccaagaccgctcggaggctgaccatacaaacggacgcgaggtagaagaaggcggcagacaatgaagctctcgtcgcctgtacaaccggggggagctagcgagccgcggcggcgatctcgaaggacgatcgccccttgcagagtgctggtgcagactgcagagagggcggtgctgctgtcgtgtcggtcgtttcttatcagctcttttgttgcctgcaaaatgaatttaaagaatgtgctctgtc

SEQ ID NO: 258 - DNA, 1649 bp, Zea mays
cacgagggggaaggccgccagggtgcgggtgcggccagaggaggtcgtcgaggccgctaacctggccgtgagcgggcagccgttcgaggtggtgtactacccgagggcgagcacgccagagttctgcgtcaaggcgggggcggtgcgcgccgccatgcgcacccagtggtgccccgggatgaggttcaagatggccttcgagacggaggactcgtcccggatcagctggttcatgggcactgtctccgccgtgcacgtcgctgaccccatccgatggcccaattcaccctggaggcttctccaggtcgcctgggatgagccggacctgttacagaacgtgaagagggtgagcccatggctggttgagctggtgtcgaacatgccggtcatccatcacctcacagccacgcccttctcgccgcccaggaagaagctgtgcgtcccactgtacccggagcttccgctggagggccagttcccggcgccgatgttccacggaagccccctcctcggccgtggcggcgccggtggcccgatgtgctacttcccggacggcactcctgcaggcatacagggagccaggcatgctcaattcggcatatccttatcagatctccacctgaacaagctgcagccgggcctgtcaccgcacgggctccaccgccagctcgaccacggcgtgcaggtgcaggtgcagcagccgaggatcgccgccgggctcatcgtcggcggccacccggcggcccgagacgacgtctcgtgtctgctcaccatcggcaccccaaagagcaagaagccaccgtcagacgtcaagaaggcgtccacggcggcggcaccgcagctgatgctcttcgggaaagcgatcctcaccgagcagcagatatcgctaggcggcggcaatgtcgtgccggcgctggcgaagaagagcccctccgacgacgacgacgacgtggccgagaggacggtgagcaactcggacgtgtcgagccctgggaggagcaaccaggacggcacgtccagtggcggaggcccggcggcgcgggcgtgctggcaggaggaggagtgcaacaacagggcggcaggttctgaggacgacctcctcgggcactgcaaggtgttcatgcagtcggaggacgtcgggcgcacgctggacctctccgccgtcgcgtcgtacgaggagctctaccagaggctcgccgacatgttcggcgtcgacaaggccgagctgaccagccacgtgttctaccgcgacgacgcttccggagcgctcaagcaccctggcgacgagcctttcagtgagttcaccaagaccgcccggaggctgaccatactgacggacgagagcagcgacagcttagcgaggtagagtccagtctcaaggagacggcggttcggcagtttcggttgggagtgggaggcgccccggaacgggagcgcgtgcgtgcgtctgatccaggaccaaagatttgtcggactagtagctctacagtagtggagtacgtacgtacaccttgatgctgctgcttctgctgtcagttcaagtggccataaccataatgcagctgcctttggtcacagtgactgatcggatgtgttgtgtacatcggaccgttgatttgcgaacgcgattactgaaagattattaccac

SEQ ID NO: 259 - DNA, 776 bp, Zea mays
gatagcttctgctcaggttgctgacccaatcagatggccaaattcaccgtggaggcttcttcaggtcgcatgggatgaaccggacttgctgcagaacgtgaaatgtgtgaacccatggctcgtggagatcgtatcaagcattccaccgatccacctgggaccattttctccacctaggaagaagctgcgggtgccccaccatccggacttcccgttcgacggccagctgttgaatccgattttccacggcaacccactcggtccgagcaacggcggcgctcttcgctgtttctcggacatcgctcctgcaggcatacagggagccaggcatgctcagttcggtctaccactaacagaccgccagcttaacaagctgcacctcggtctgttccaaggcggcggttttaaccggcggcttgacgctatcactccaccatgccctatatcgaggggctttgtgatcggcagtgcaccggtcgacgagagcgtctcttgcgtgccgacgatcggcacgccacgggccgcagagagatctgacgacaggaagaaaccacatctaatgctgttcggaaagcctatccttaccgagcagcagatgagctctagagggtcaagggaaacactctcccctgaggccactgggaacagttccgatggcagtgttcagaaaacgggaaacgtatccgatggctctggttcgtcgatctgcatcggttcctcgtcccgaggccgcgaggcttctaggctcgggttcgaatttgaagccgggcactgca

SEQ ID NO: 260 - DNA, 1087 bp, Zea mays
cccctacgcccgggtggcatcattacgccggccttatgcgaggtaatgtgagcccttgcgcggctgccaaggcacggggcaaggtgcgaccagaggacgtggccgaggcggcgaggctggcggctgccgggcagtcgtttgaggtggtgtactaccctcgcgcgagcacgcccgagttctgcgttcgcgccgccgcggtccgcgcggcgatgagggtgcagtggtccccagggatgcggttcaagatggcgttcgagaccgaggactcctccaggatcagctggttcatgggcaccgtcgccggcgtccaggtcaccgaccccatccgctggccgcagtcgccgtggcgccttcttcaggtgacctgggacgagccggaccttctgcagaacgtgaagcgggtgagcccatggctggtcgagctggtgtcaagcatgccggccatccacctcgcctccttctcgccgccgcggaagaagccccgcatcccagcgtaccccgagttccccttcgaagggcagctccttaacccggcgttcccgcccagcccactgccacacggccagcaacaccaccacaatttccttcacgcccacccaccgtcgttcttcccgttcccggacggcagtgctcctgcagccatacagggagccaggcatgcgcaatttgttccatctttatcagatctccaccttatccacctgcagtcgagcctgctgtaccctgggctccgccgtcccgaccatgtcggtccgacgatccctatcccgtcgggaatcagcaccgacctgaccatcggaggcgcaccggcgcgcgacggcgtcccgtgtgccctgtccgtcggtgccagcaagcagaaccccgacgccgtcaagccggcggggctggtgctcttcggacggaccatactaaccgagcatcagatgagcctcagcagctccggcggcgccacctccccagcggcgactggtaacagctctctgtgctggaccgccgagaagggccccaatgtctcggagggctcgggctcgggctcgggctccggcgtcatccagaacagcccgaccggcaagaacacgtcgtcgga

SEQ ID NO: 261 - DNA, 1414 bp, Zea mays
ctccaactcccaccccaatacatcctgccgacgccatcagccggcgggacgcacacacgaggtcgaccttcgaaccctagtccttggccgagccgccttgcgggatcgtccccgccgcgcggcagctctgcctcgacccttttagtctccgtccgacaccgcttggatcagtgctgtgtgctgtcaggagccgtggggcggcgcgaccgcgctggctgcctggctcggaggcagcttggcagcttgcagtggccagcgcccagcggctgctcgcgcgtaggcgcaggcgcgcacggcgcagcggccagcggcggctcggacgctcggtcagcccctggggcctggctgcctgggctcggtcgctcggaggcaggcagggaggcaggcatcggctctgcctctgctggctgcggctgctcgtggcctcgcgccgtcgcgctcgcgcgcaggggtgggaaactggggccgctgctcggtcgcgcgcaaggagatggaatcaccacccctcacagctgaagcaattgcttttaccgagaaaaagatggacatgactttggaggatataatcaagatgtcaaagaaaaagaatcctggaggcaagaacccccctaggcagccgatcaaaaagcgtccattccagaatgccaacactaataaagggaatggcaaggttcaacggtttatggaatctagatcaaccattagacaaggtgttcttgcacagagaaggtcaaatcttggtggaagtcagtttgctgctacaaagcaggctgcaaagaaggctgctgctatgccaatgcgcagcggggctgtctattggaagaagcctagtgcaagtaccttagtgcagaggaggtcagtaggtgatgcttttcaaaataccaaggtcaaggagtcgcagaaccatgcagcaccaaggacgatggatgcactctttgcacggatgaaggcgcaacgcatgaggaccgcaccacagcagcaggcaaatcctgcctctggacgtgatttcaaccagcagcgacgtgttcagcagcagcagaggcgaggtagagcatatggtggccgtgttgtcggcaaccaatgagcatatttggtgcatcgaagccccttctcttcactggtcttaaggaccttgagggctagtttgggaactctatgtttctctattttctcaagtgaaaatgagctaatttttcttgggaaaatgaggttttcaaactagccttgaatgaaaggacgccgggggaaaatctaacttgactttctttgttggatgaaaggatgtggacagaatatgaagcgaattttgtgtgactctagttgtctgcttctgttcagcatgtacactgacctacggaaattacttgctagattttgatgtcatgtttattgagttgatttggttcgtctcttc

SEQ ID NO: 262 - DNA, 1312 bp, Zea mays
cacgaggtcgaccttcgaaccctagtccttggccgagccgccttgcgggatcgtccccgccgcgcggcagctctgcctcgacccttttagtctccgtccgacaccgcttggatcagtgctgtgtgctgtcaggagccgtggggcggcgcgaccgcgctggctgcctggctcggaggcagcttggcagcttgcagtggccagcgcccagcggctgctcgcgcgtaggcgcaggcgcgcacggcgcagcggccagcggcggctcggacgctcggtcagcccctggggcctggctgcctgggctcggtcgctcggaggcaggcagggaggcaggcatcggctctgcctctgctggctgcggctgctcgtggcctcgcgccgtcgcgctcgcgcgcaggggtgggaaactggggccgctgctcggtcgcgcgcaaggagatggaatcaccacccctcacagctgaagcaattgcttttaccgagaaaaagatggacatgactttggaggatataatcaagatgtcaaagaaaaagaatcctggaggcaagaacccccctaggcagccgatcaaaaagcgtccattccagaatgccaacactaataaagggaatggcaaggttcaacggtttatggaatctagatcaaccattagacaaagaaggtcaaatcttggtggaagtcagtttgttgctacaaagcaggctgcaaagaaggctgctgttatgccaatgcgcagcggggctgttttttggaagaagcctagtgcaagtcccttagtgcagaggaggtcagtaggtgatgtttttcaaaataccaaggtcaaggagtcgcagacccatgcagccccaaggacgagggatgccctctttgcccggaggaaggcgcaacgcatgaggaccgccccccagcagcaggcaaatcctgcctctggacgtgatttcacccagcagcgacgtgttcagcagcagcagagggggggtagagcatatggtggccgtgttgtcggcacccaatgagcatatttggtgcttcgaagcccctttttttccctggttttaaggcccttgagggctagtttgggaactttatgttttttttttttttcaagtgaaaatgagttaattttttttgggaaaaggaggttttcaaactacccttgaaggaaaggacgccgggggaaaatttaacttgactttttttgttggatgaaaggatgtggacagaatatgaagcgaattttgtgtgactttagttttttgtttttgttcagcatgtcccctgccctacggaaattacttgttagattttgatgtc

SEQ ID NO: 263 - DNA, 847 bp, Zea mays
cgccatcagccggcgggacgcacacacgaggtcgaccttcgaaccctagtccttggccgagccgccttgcgggatcgtccccgccgcgcggcagctctgcctcgacccttttagtctccgtccgacaccgcttggatcagtgctgtgtgctgtcaggagccgtggggcggcgcgaccgcgctggctgcctggctcggaggcagcttggcagcttgcagtggccagcgcccagcggctgctcgcgcgtaggcgcaggcgcgcacggcgcagcggccagcggcggctcggacgctcggtcagcccctggggcctggctgcctgggctcggtcgctcggaggcaggcagggaggcaggcatcggctctgcctctgctggctgcggctgctcgtggcctcgcgccgtcgcgctcgcgcgcaggggtgggaaactggggccgctgctcggtcgcgcgcaaggagatggaatcaccacccctcacagctgaagcaattgcttttaccgagaaaaagatggacatgactttggaggatataatcaagatgtcaaagaaaaagaatcctggaggcaagaacccccctaggcagccgatcaaaaagcgtccattccagaatgccaacactaataaagggaatggcaaggttcaacggtttatggaatctagatcaaccattagacaaggtgttcttgcacagagaaggtcaaatcttggtggaagtcagtttgctgctacaaagcaggctgcaaagaaggctgctgctatgccaatgcgcagcggggctgtctattggaagaagcctaggtaaacaatgggtatcttattgcttatgagaaagtttactgcattca

SEQ ID NO: 264 - DNA, 937 bp, Zea mays
cgattagactagttgttcgagcacatcatcgctgcttggcgtggccgtcaagtgcaagcagtgtgcgactgcttcgtcctgttccacctcgcgctcgcggctccgggccataaacatacaccagaccacacgaggagctcgatagccatgtaatgtaaagtgaagcaaagcaagcgaaacaagccgccgccgcctctgctttcctctcgatcacctccggcgcccgccaccaccgcgccgccgccgtcgtgatacttttgcccctccttttttttttcttgtggtctggtgttgcgctttttggggcgggcggatggggaggagcggcacgtcgacggtgaggctgctgctgctggggagctccttcctctgcgtgcttctcgtcagtacctcagaacctgcctcggagtcggatgacgtatctgcgcttcttgcgttcaagagagccatctacgaggaccctctgtccaagctctcggactggaactccaaggacgaggatccctgcgcctggtccggtgtagggtgctcagggctcaacaaccgcgtggttgcgctcgacctgtcaaattcatctctccaaggattcttggcaccagagatcgggtccttgagatctttgcaaactctcgtgttggatcgcaacacattcatgggctcaataccaaaaggcatcggcatgctacacaacctgatcgagctgaacctcagctccaaccagctcgcggggcctattcccagtgagatcggtgacatggcgaagatcacaaaaatagaccttcacgccaatcggctggacggcactatccctcctgagcttggcaagctgggaagccctccttgagctacggctgaacaacaactgccttacaggcattgttccctgcagtaatgattccgacgtggaatccgccagcagctctgatcaaattggatt

SEQ ID NO: 265 - DNA, 999 bp, Zea mays
gccgcgctgcgctgtccgtcgcttctccgttcgcgctactactgccgctgcgggctgcggctagaaaaaaaaaagcagcgccgcgcctccacctcgactccgggccagggcagccagcctacccagacaaccaaacgaacccgcccggagcagcaaagcataggcgctcgagcgctccctcctgagctcctccgcctcacggtcacgcctcgtgtccccccaccccctcctcgtcctccaccggccgcctcacgccgtcacctccgctcggcgagtctcggctccgaccccagccgccacgtgcgacctcccctactcctgactcctgagagatctgcggggctcggcatggggtgaccagatcgggccgctgctcggtgctttccagctgaattctgcccgcagctcgtgtcggaggcagcggagatggcggaggccggcgtggcacgcggctcagggagtgctggcgatgctttgttcagggaactctggcatgcttgtgctgggccgttggtcacagtgcctcgccaaggcgagctggtttattacttcccgcagggtcatatggaacagcttgaagcgtctacagatcaacaacttgatcagcacttgcctttgtttaatctaccgcacaagatcctctgcaaggtggtcaatgtagaacttagagctgaaactgattctgatgaagtttatgctcaaattatgctgcaaccacaaacagagcaaagtgagcccaccagcccagatcctgaaccacctgagcctgaaagatgcaacattcattccttctgcaagaccttgactgcttcagatacaagtacccatggtggattctctgtcctcaggaggcatgctgaagaatgtttgccccaactggacatgactcagaatccaccgtggcaagaactagtggctaaagatctccatggaaatgaatggcatttccgtcacatctttcgagggcaaccaaggaggcatctacttacaacaggctgg

SEQ ID NO: 266 - DNA, 717 bp, Zea mays
cacaaaggcgaccagtactggagttgggagaagctgaggcgtttttcgtgccgctggctgaccggccggctggtggcttacatagccagctagtgtgtgctctactttcttgcgtgtaatctcgcacaaagctagcttggagccgaataatggaagccacgatgaagctctgcaacgttgcgacggtgaggagctctgtcaccggcaagccccgcgagcaggaggaagtgtcctctcggcatgaagaccagagagagcctgcagttattatgccaccgggagcatcggttcacgtggttcatgtctagtattagcatggtgttatcctgattgagcttttttttgattgagcttttttttaatttaaggtttctattcttcttcgtatctctatatcgtcggatcttcttgaccttgcaagaccttttcttgaccttgtaagacccaactctaccgtctttctttccttcaactcaatcttaacagtcttccacctctctttttatccttgcttcttctctagctctatcccttctgagctgtgggttcaactatatgtttacatgtttagatattagattatccctggattaattattctatgatataattaagtttggtgggagtaaataggtggcttggtccttttcatatatgtgatgtaatgctgtgaactcattctcaaacaagcatattttgttttgatggtagagtgcc

SEQ ID NO: 267 - DNA, 668 bp, Zea mays
ctggagctgggagaagctgaggcgtttttcgtgccgctggctgaccggccggctggtggcttacatagccagctagttcgattcgatcgtgtaatctcgcacaaagctagcttggagacgaataatggaagccacgatgaagctctgcaacgttgcgacggtgaggagctctgtcaccggcaagccccgcgagcaggaggaagtgtcctctcggcacgaagaccagagagagcatgcagttattatgccaccggaagcatcggttcacgtggttcatgcctagtattagcacggtgttatcctgattgagcttttttttaatttaagatttctattcttcttcgtatctctatatcgtcggatcttcttgaccttgcaagaccttttcttgaccttgtaagacccaactccaccgtctttctttccttcaactcaatcttggcagtcttctacctctctctttatccttgcttcttctctagctctatcccttctgagctgtggattcaactatatgtttacaagtttagatattagattatccctagattaattattctatgatataattaagttcggtgtgagtaaataggtggcctggtcctttttcatatatgtgatgtaatgtaatgctgtgaactcattgtcaaacaagcatattttgtttt

SEQ ID NO: 268 - DNA, 506 bp, Zea mays
  misc_feature (355)..(355): n is a, c, g, or t
  misc_feature (443)..(443): n is a, c, g, or t
cgagaagctgaggtttttcgtgccgctggctgaccggccggctggtggcttacatagccagctagtgtgtgctctactttcttgcgtgtaatctcgcacaaagctagcttggagccgaataatggaagccacgatgaagctctgcaacgttgcgacggtgaggagctctgtcaccggcaagccccgcgagcaggaggaagtgtcctctcggcatgaagaccagagagagcctgcagttattatgccaccgggagcatcggttcacgtggttcatgtctagtattagcatggtgttatcctgattgagcttttttttaatttaaggtttctattcttcttcgtatctctatatcgncggatcttcttgaccttgcaagaccttttcttgaccttgtaagacccaactctaccgtctttctttccttcaactcaatcttaacagncttccacctctctctttatccttgcttcttctctagctctatcccttctgagctgcggattca

SEQ ID NO: 269 - DNA, 2289 bp, Zea mays
ggatctttcgctttccttaccccgttagcgttcctgcttgatacactacgactgcagattctttggcagaccgctaccaagtgcaagtgtgcaacgcacacacatcactcacagtctcacggtgtctctgtgcgcgcgcgtgggacacaggagggagagagacacagagaagggggcgggacgatcagctctagctcagctggtatcgtctaaactgcataaaaggggagggaaaaaaagttgcaatgatgcatcccggcgcatagatagagagagagagagaagagagagccccgactcgagagccaagaacgccgtgtgttgtgtttgtgtgcatctatctccgtacacgcacgcacgcacgcaccagctagcacgaccgccatggccgccaccaggagagccttcttccacagcgccgtcgacggcattgcgcgcgccgggccgggggaggccgagcggctgccggcgccgccgcaggtcgggcgaccgggggaaggcgccagcagcatggtcttgggcttccccgggccgcggcccacgatgccggaccgccggccggccgccgccacccagcagttctttccgcccactactacggccgcgcagcaggcgacgatggaggagcaatgccacgtgcccgccggtagcgcggcggagcagggggtccggtcgtcggcgtccagaaagagccggcgcggcccgcggtcacggagctcgcagtaccgcggcgtcaccttctaccgccgcaccggccgctgggagtcccacatctgggactgtgggaaacaggtgtacttgggtggattcgacacggcgcaggccgctgcgagggcctacgaccaagccgcgatcaagttccgcggcctgaacgcggacatcaacttcaccctggacgactacaaggacgagatgaagaagatgaaggacttgagcaaggaggagttcgtgctggtgctccggcggcagggcgccggcttcgtcaggggcagctccaggttccggggagtcacccagcacaagtgcggcaagtgggaggccaggatcggccagctcatgggcaagaagtatgtgtacctgggcctgtatgacacagagacggaggctgcccaggcatatgacaaggctgccatcaagtgctacggcaaggaggcggtgaccaacttcgatgcccagagctacgacaaggagctccagtcgcagccctgggacggcgagctggatctcgagctcagtctgggctgcgccagcagcgatccgtccacggtcgccgtcgaggcgttcagccccgcgacgagcagcagtagccgcaagcagaggacgatgacgctgacgctcggtctgccggaggaggaggagacgggcgccggctaccctcaccctgctgccggcatgttcgggcgcccggctgatggccacgtccacgtagcaccgccgccacaccggcaatggcagcagcagcagcagggacagcacgcagctccagatgcggcgcctgagcgacgagcggcagagccagcagatcggcagcggtggggccggggcgcgcgctggcccatcgccagcgccagcggcattaactgggcctgggcgccgccgtacgccaccgcccgcgcccggcaccgacgacgacgacgccagcagcgccgccgctgcagcatcatcaggattcccactgtggcagctgggtgcggcgtcgtccaggtccagctggcccagctgctgagcctttcctgtcgtcccgcgccagcaacagtgacgctgctgggccacgtactgacggcgactggtgacctgctgaaaccgccgccggcctgtttcccttttctaggtaaaagcagtggcagaggggcgagctagcgacagcgtgcctcgtcatccatcgtccctgcgccgtggctggcggggtgggaaaaaggtctgagcagttttgagcgtccggaggagctcgacgatttcctgccctcgaatagtcacttggggtggccactagttattatttctttccttccccctcgttgattctgctacccattatagcttctgtatctagctacatgcatgatgctgctctagcgctgttggacgttgatggcacggtgtacggatatgggacagggttcgtgtgaccccatgtccactgctaggcctgtttccaaatggaatatttctgcagtaccatggcttatagaaatgccgagtattttaaaccattaggtgcttggttactttcccaaaaactaggttttcaaagctatggtataatgaataccacggtatatatttttc

SEQ ID NO: 270 - DNA, 2016 bp, Zea mays
ggcacgagctcccactgcactgctgctccgctgccgctaccctttccctctcccttctcgtcctcggtcctccccaacccatggccacggccaccaccacccactgccccttctcccaccacgctatttatcgcggctgcacgactcctgcccatcaggcgccatagagacgcgtgggaccgaagccgccgatcaagcgctgctcggggcggagcagcggccggcggtggtgagtgctggcagacaggccggcaggtcaggcagagtgaccagctggtgagtcgaagcttgagcggggagctggactttggcgggttccggcgggctccggagcggagatggtgctggatctcaatgtagcgtcgccggcggactcgggcacgtcgagctcgtccgtcctcaactccgcggacggcggcttccggttcggcctgctcgggagccccgtcgacgacgacgactgctccggtgagatggcgcctggcgcgtccacggggttcatgacgcggcagctcttcccgtccccgaccccgccggccgagccggagccggagccggtggcggcgccggtgccggtgtggcagccgcagcgcgccgaggatctcggcatggcccagaggccggtggcgccagcgaagaagaccaggcgcgggcctaggtcgcggagctcgcagtacaggggcgtcaccttctacaggaggacgggccgctgggaatcgcacatctgggattgcgggaagcaagtctacctaggtggttttgacactgcgcacgcagccgcgagggcatacgatcgagctgcgatcaagttccgcggcctcgacgctgacatcaacttcagtctgagcgactacgaggatgatttgaagcagatgaggaattggaccaaggaggagttcgtgcacatactccggcgccagagcacggggttcgcgaggggaagctccaagtaccgtggcgtgacgctgcacaagtgcggccgctgggaagctaggatggggcaacttcttggcaagaagtacatctatcttgggctctttgacagcgaagttgaggcggcaagggcttatgacagggctgcccttcgcttcaatgggagggaagctgttactaactttgagcctagctcctacaatgcaggagataataacctgcgtgacaccgaaaccgaggcaattgatgatggtgatgccattgatttggatttgcggatttcacagcctaatgtgcaagaccccaaaagggacaataccttagctggcctccagccaacatgtgattcccctgaatcttcaaatacgatggcttctcagccaatgagctcatcatccccttggcccgggtatcaccaaaacccagcagtgtcatttcaccatcagcgcttgtactcgtcagcttgtcatggcttctttccgaaccaccaggtccaggaaaggccggtggagcgaaggcctgagctgggcgcccagccattcccctcatgggcatggcaagcgcagggctcccctcacgtgccgttgcaccactctgcagcatcatcaggattctctaccgccgccggggccaacggcggcatgcccctgccgtctcacccgccggcgcagttcccgactactacaaacccgttcttcttcccctagaccgcttttgacatgacagcttgctgttccggctcagctctcggcgtctgggatggcagctggtcttgcgtgtggcgtctagcagctctggtgatggaagaaagtgattgtgttttgtgtgtgtgtgtgtgagagagagagagagccataataagaagcgacatggctggtctccctctggtatgtgcctgttaggatatgggatatctccatgcatggattgtttccgagacagtagtagtattttgttgtagtcgaccatgcgtgtacatcagtataactggatctttgaagagctgagattttatgactcaacaagcattgacataatggcatgcactccaggaccactgaagcaaaaggccaatttgacatc

SEQ ID NO: 271 - DNA, 973 bp, Zea mays
tgggaggcgcgcatggggcagttcctcggcaagaagtacatataccttgggctattcgacagcgaagtagaggctgcaagagcctacgacaaggccgccatcaaatgcaatggcagagaggccgtgacgaacttcgagccgagcacgtatcacggggagctgccgactgaagttgctgatgtcgatctgaacctgagcatatctcagccgagcccccaaagagacaagaacagctgcctaggtctgcagctccaccacggaccattcgagggctccgaactgaagaaaaccaagatcgacgatgctccctctgagctaccgggccgccctcgtcagctgtctcctctcgtggctgagcatccgccggcctggcctgcgcagccgcctcaccccttcttcgtcttcacaaaccatgagatgagtgcatcaggagatctccacaggaggcctgcaggggctgttcccagctgggcatggcaggtggcagcagcagctcctcctcctgccgccctgccgtcgtccgctgcagcatcatcaggattctccaacaccgccacgacagctgccaccaccgccccatcggcctcctccctccggtactgcccgccgccgccgccgccgtcgagccatcaccatccccgctgagagaatcaagaagccgcactgtaaatctgccgggaagctagcattttccccccggcccctccccctctccgggcgttgcgactttttcagttttgcgccgccggccggggtggtggtttcttgtagccgatcgattggattcctcgtattactgctgcttacactcccaattaagtgaaaaaaaaacgctcctctactctttcccctaccccccctgttagctgatcgattggacgtacttgctagctgctgttgctgctgctagcttgagattgactaacttgagcccttggattgatcaaaatctatatgactatatagacgacac

SEQ ID NO: 272 - DNA, 1004 bp, Zea mays
agggttgattctgtagagcgtatgatagggcagccattcgcttcaatggaccggatgctgttaggaactttgattctgtttcctatgatggagatgtcccacttccacctgcaattgagaaagatgtggttgatggagacatccttgatctgaatttgaggatttcacaacctaacgtgcatgatctcagaagtgatggtaccctgactggttttggattaagttgtaattctcctgaagcttcaagctccattgtttctcagccaatgggcccccagtggcctgtccatcctcacagcagatcgatgcggccccagcatccacatctgtatgcatctccttgtccaggcttctttgtgaacctcagggaggcgcctatgcaggaagaggagaaccggtccgagccggcgtgtccccagccgttcccctcctgggcatggcaaacgcagggctcccgtgccccagttctccctgccaccactgcagcatcatcaggattctctaccgccgctgccaccggcgtggacgcggccacagccggccacagcgtgccgccgccgtctggtagcctccggcagttctcgggctaccaccagctccgcttccccccaaccgcctgacggagacagaccacctcctgttgagttggcggcggcggcggcgtctcatagctggccggtggttggctggctgcccatgcaacgccacgccggtgggtgcgggtcggtattcggtaacagtcgccactgttgggtatggttttgtgggactacagaggatgcagtgatctctcgctgctgctgtgtgctgtctctctcgctccctctacccacccacacctgtttgtaatatgaatttatcgccctctcgcgctcgtgattcgtccatcttcgtttcgttttgatggccaccggatgggatcatgagcgtgttgcgagaaattgtgtaataaaccatgcgtatttttatttatatttatttattgtgacgatggtaaaaaaaaa

SEQ ID NO: 273 - DNA, 1287 bp, Zea mays
gtccccgtcccctgcctctctctctctctcacatccccatgctctctgcttgtgcttgtggcaatgcagggattgcggcaagcaggtctatctgggcggatttgacaccgcccatgcggctgctcgggcgtacgatcgagcggcgatcaagttccgcggcgtggaggccgacatcaatttcagcttggaggattaccaagacgacatgaagcagatgtgccacctgagcaaggaggagttcgttcacgtgctccggcggcagagcacggggttcccccggggcagctccaagtacaggggcgtgacgctccacaagtgcgggcggtgggaggcgcgcatgggccagttcctcggcaagaagtacgtctacttgggcctgttcgacaccgaggaggaagccgccagggcgtacgaccgcgcggccatcaagtgcaacggcaaggacgcggtgacaaacttcgatcccagcatttacgccgaggaggaggtcgcgccggcggcggcgacgggcggcgccgccggcgacgagcacaacctggacctgtcgctgggaagctcggcggggaacaaaaggggcagccttgacggcggcggcggcggcggcggcgacgacaagtcctcggaccagcgcgtccccatggcgttcgacatcgactggcagacggccgcacgtcggagcaccaaggcaaagctcctgagcaacggcgatccggggaccgcggcgggaggcctttccctggcgatcggcggcggaggcgggcactggcctccgcagctgcagcatcagcagcagcagcagaggctccacggcgccaggaacaacggcggcggcacgagctggccgccgccgcccgccacccgtgcccgccgccagtaccggccgccgccgcgaccgcagctgcagcatcatcacgattccatccctacgttgttacgagtacgacgcaaagcccggccggctgggtccagaagaatgggttccattcgctggccaggcccacgtagaccaagaaccaggactgggcgttcgtccttcgatcgtattccacggcgaaggtccatcatttgacccaagggcaaacggctcgtcgatccaccgatttacaccccctccccctttctttcccttttccattctctgtgttcttgattgggtgagacatggatccgaggatggatgggcctgctgcccccctgctgtaaatgaggagtttccgggaagaagacgagtgctttggtaggcgactaggcgtcgcgtcaggcagtgcgtccttttgccgcttttta

SEQ ID NO: 274 - DNA, 2040 bp, Zea mays
gctggtcgagatacccgacgacgcggacgacgactcggccgccgccgccgcggaagccgtcgtcacgcgccagttcttcccggccccggccgccgtcggcgcggcgcccgggcccggctcgtcgagcgcgcgcgcgggctggcttcgcctggccgccgcggctccaccgcccgcggcgggcggcagtaacggcgtcgcgcaaaccggtggccccgcggcggcggcggcggcggctggcaagaagagccggcgcgggccgcggtcgcgcagctcgcagtaccgcggcgtcacgttctaccgccggacggggcggtgggagtcgcacatatgggattgcggcaagcaggtctatttgggcgggtttgacaccgctcatgcggcggctcgggcgtacgatcgggcggcgatcaagttccgcggcgtggaggccgacatcaatttcagtctggaggattaccaggacgacatgaagcagcagatgggccacctgagcaaggaggagttcgttcacgtgctccggcggcagagcacggggttcccccggggcagctccaagtacagaggcgtgacgctccacaagtgcgggaggtgggaggcgcgcatgggccagttcctcggcaagaagtacgtctacttgggcctgttcgacaccgaggaggaagccgccagggcgtacgaccgcgcggccatcaagtgcaacggcaaggacgcggtgacaaacttcgatcccagcatttacgccgaggagctcgaagcgggcggcgtcgacgggcggcggtggcgatgaccacaatcacaacctggacctgtcgctggggagctcggcggggaacaaaaggggcagccttgacgacggcggcggcggaggaggcggcggcgacgacgagacctcggaccagcgcgtccccatggcgttcgacgtcgactggcagacggccgcgccccggagcacgaaagcaaagctggacgcgagctccaagcaaccccagacccagatgctgcctcctccgcctcctgctgtcttgcgagtcgcccaccagctgccgttgccgttcggtcccaggcatccgcaatcgcagttcctgagcaacggcggcgatccggggacctcgggaggcctgtccctcgcgatcggcggcgcgggcggcgggcactggcctccccagctgcagcacctgcagcagcagaggctgcacggcgcctgggccaacggcggcggcacgagctggccgcttccgcggcacccgcacccgcacccgcacccgccgccaccgagcaccgccgcgaccgcagctgcagcatcatcacgattccctccctacgttgttattacgacgcaaggcccggcaggctgggctcagaagaatgggttccattcgctggccaggccaacctagtatgccaagaaccacgactggccggagcgttcattcgtcgtcgatcgtcgacccagggcaaacgacacctccaaccactgcacgacgacgttttaatttaccggatgccattctctctctcccctccccccttcccttctcccttctcccttctcccttctctgtgttcttgattgggtgagacatggatccgaggatggatggacggcctgtacctgaggagttcccgggaagaagacgagtgagtgagtgagtgattggtagggtaggcgactaggcgtcgcgtcaggcagtacgtccttttggcgccttttttcttctttcactcaccattggcgaccaccaatgaatgatgacactgactggggtgtcaacatcgcagctggttttgtttggtctcatgttgcatcactcgctgctccacgatgccttgctatggttgggtgagatttgctccatccaccccacgccggtcaggcgacagagcctccgctgcgtcgtctcgtccgtctggtgagttgccactgtcttagaatctgagtggtacggtacgtgtggatctcgcgcgcgtgtaaacctagtattatgtactacaaactgtcatcatcggagatcactcgaataagatatcgatctggagatt

SEQ ID NO: 275 - DNA, 710 bp, Zea mays
ctgtgttccaagttcatcattcactcgtcactaatagctttctatctgatcgattcatcatcatccgggcatgcatgagcatcatcgtctccagatcgttgggctctcgcagctacctacattcaacattcaagctcgctctacatatgcatgcaaatctgcaacactcgctcttggcagggatacattcacgccgagagagagagagagagagagagagagagagagagagagagagatgtgtgtgctgtagtcatcagccagccggtgatttctggagtggcatcatcaagattcacacactgcatgccaacataatgcgcgtgttcatgcatccatcgccgccgctgcatcatgcatcatatataatatatatatatgtgtatgtgtgggaatcttgatgatgctgcattggatatcaagggctatatatatatatggatcaagcatatatatatatatatcagatcaccagtcatatcgagttcttccttccaggcttgctaggtaatttataacttaaaccttgttgctgaactaactaattttacttagctagctagctactactatacttcattgttagtagtagctagcaagaaggaaagtaggcatcccggccggttcgtaccttctttttttttgcacagcaggatctgaccttctgtataaaatgcatttttgccttgagtttttttgtttttccacag

SEQ ID NO: 276 - DNA, 601 bp, Zea mays
ccgagttccataggacgacgttaccacgatttagtgcaaatatatctgcttgtacaaaacaaaatcacagctaacgctgaacgaaacagctggtcacgagtacccttcttactacgtgactacgagaggggcccacccggctcgtattcaaaattgagggaaaaaaattattaaaaaggcttcccgaatggcaggcagcatcacttgagaccatcaccaaggcccgcaggcattcctaagctctgtgccaagtcaaacatcctctctttcatggcctgcaggcattactccgagatcaattttaagtataaatgtagacttcacattatctatacactgatccttatcttattgggtatgcaataaagcatcatcatcaagattcacacctggacgctccgttgatgcgcatccttgtatgcatcattgaccagctccgaaagtttctggaaggtacacaacaagtggggagtggaggtaagcaattgattgacgacaaattgaaatgttgaggtgacctaaaaggctttcctccctccctctatctacaatgtattactaatctacaagttctcacctttatacgtaaccgagtttgata

SEQ ID NO: 277 - DNA, 1238 bp, Zea mays
aaacaacataggactatttaagttttagtcacctacactttggttgggctacaactagtccagcggatccaacacatgctctcatgatcatgtataagcaccccgcattgatcatttattagaatgagattgaaatgggatgttacgatccaaacatgctcatgctcatgtataaggacttggcatcaaccattactagaatgagactgaaatgggagatcatgtaaacgcgggggtaggtggcatgcgtgagagcttatcacaattgtccttttggttggacgctctctctgtggtaactccaattacacacacacacacacaaagctttgcagtggccatcagttgccctcgcacgtacgaacggtttatgaccagctagctttcctttgctggtttccagacatggcgttgcgtgtgaccattgatttgcttctactaataaaaggttcccagaataacttgtcagctcatatcgatcatcagtaaacacgtccattttccattcattcacattgactggaacacgtcatcagtaaaaagaggggaaattgttgaggatataatatacgcacattaattaatgcagagttcagcgaggcaaagaactaacggatgtgatacggacggacaccgcggcggcaacgtccgcgcgcgagggcgagtgggacgtgatattggcacggctcaatcagagagcagagccccaccccccctggcctctgctagggctcgagctctcgaattgaaccgcgtcaataccccgtctagctcgcggccattgcgtgcatgcacgcacgaggatatcgccattaattagctttagttagccacccacctcgatcgatcccgaatgtactagaggcaggcaggccggtcggcaggaagacgacttgcatggatggatggatggatggatggagccgcggctcctttccttttgcagcaccagcacgtacgctgcagaggaagaagcgacagagtgaggcgtgaagaagaagaagaagaagaagaagaagcagcagcagcagcagggcagcgaccggacggcgatgagcgcatcaatggatgaatggatggatggatgaatgaagcagcgagtaggcgacgacgcgggacgggaggttgggggcatttattggcgacactgaaggaggatagactagagagagatgtatgccatgccatgcctcgagtgagtgagatgcatgcatcatatctccaggcagggcagggca

SEQ ID NO: 278 - DNA, 770 bp, Zea mays
gctcatatacactgccaaaatgaaagcaagctttgagcaacaatagagtaccctagccccttgtagccacacagctagcacgcacacgccgaccattatttgcttgcaagaaataaagaacagtttgactccctgttcataagaaacttctgcgcggttccgatccacccctcctgctggtgtcaactcttttgaattatcccctctgctggagcttcgatcttgaggaagtttttttaggccacgttcggttataagtggtttgagagggatcgaaggtgatttaatctcctctgatcccatcacaatcgcaggactataggtcaactgctgccagtgccacctactatacttgtaaacatgacctgataataatgccacaaacagtacacacatccatggtatatacacgatatatagatggaaaaccgaatcttaattaaatttcacggcgcatagcaggacgacaaagaacacaaaacccccgtacctgtagtccactccacatatataggctagagaaggttgtgatattggcacggctcaatcaattaaacactgcgcccgcacctcgatcaaaaacgcagaattaataagctaagccacccgcggccggcgagttgattgagccatgccaacatcgcactctctcagccaacaaccagacgccaccaccccttctcgatcgatcgccatggacgacgactacccgagctcccagccacgcaaccctaaactggagggagacggagaacttgagctgctgtgct

SEQ ID NO: 279 - DNA, 1388 bp, Zea mays
gtagcgtgctatagctatcacacagcggcaacaggcaggtgtaggcacaccgctcctcctcgctgttctacgcccacccgcacaagcaatcgtcgcatcgccaccaccaccaccgagaagcagccgcctcgcgccccagatctcgccggcaggggtcgcacgccctagcatgcgcgagtaagtacatgagggcggcgcccttcagtgccgacgggaaaggggcggggaccatagaggcgctgctttggccgaacgggaagggcggcggcggaggggacctgctgttggagccgacgtcggtgctggactgtagacggagcccgagcccgcggtactcgtcatcgacgctgtcttcgtccctgggtggcgccgcgggagactcctcttccggcgtggcggcggtttcggagaacagcgccgccgccgccgccgaagccaccaaatgggcggcgccaggcgagcaccgcggcggcggcgaaggaggcggaggcggaggaagcaggaaggagtggtccggcggtgagctgccgcccataccggggaccctggacatcggattcggcgcggaggagggctgggatgccatgctcggcgacgccgcggcggtggtcgggcaggaccagacattcctcaactggatcatgaccgcgccgggcgacatggaaccgccggcgctggcgctcctcggtaatgccgccggcttcgagttcccggcctcggacccgatcgggttctccctgcagcatcaccccaccggcggcggcacctcggttggggcgctggcctccgacctatcgtcccccagcgcgaggtcgctcaccagcagcagcggcagcagcagtaaggccacttccactttcggcctcctacgaaccgaggcagtttttcagccgccgccgccggccacgaccatgcctttccacgacggtgccgacataaagcccgctcaccttggagtcccgtcggcaagtctactcctcaatcaacaccaagcgttgtcagcagcctccttcatgccgctcccctccttccctgaccatcagcaccagccacatctcccgcccccgccgaagcgccaccactctatgcccgaaaacctgttcctccaaaaccaactccagccgccgccgccgccgccgcagggtctacgattcccaccactgcataccaccgcgcccttccagctccaaccatcgctgcaaccaccgcgaggttcgatgaaaacaaccccggcggcgcagcaacatcaacagcttctggatgagcttgcggcggcggcaaaagcggctgaggtcggcaactccatcggcgggcgcgagatattggcgcggctcaatcagcagcttccccctatcgggaagcctttcctccgctccgcttcctacctc

SEQ ID NO: 280 - DNA, 1840 bp, Zea mays
cgcaaatgcgacgtgcaagttgcaataccaacagcaacaccatcacctccgaatccgatccctcacacgcccacaccaccttggtggtgggtcttggttcatgctgcccactccggcactcctcttctcatgacaagcgcgctgccgcacatgtctgagctcccggacggcggcgccggcggaaatggccaagacgaagccgccgccttcgcctcgccggccaagcgcctccgtaggtcgccggcgctcgagcccacctccgtgctctacaaccgcagcccgagcccgcccacatcctcctccctggtctcctccgccgcgcccgagccgccccccatcagcgccgaggattgggaggccgtcctctccggcggcgacatggccgcgccaccagccgccgcgcggtctcaagacgcctctttcctccgctggatcatggacgccgacgcccaagtcgacgccttcgatcccttcctgccttgccaagagaccgccgtcgtcgagcccttcttgcagccgcagctcccgctccccgtggccgacgacctcgagccaggggcgacggttgacgagctcctcgaggcggtgcgccgcgccgacgccggggactccactggcgcgcgcgagatattggcgcggctcaatcaccggctcccctcaccgccggggcacccgcaccctcctatcctccgcgccgcggctcacctccgggacgcgctcctgcgcgtcctcgtcacgtccgcgcccgcacccgccgccgtctcgacgaccccgctcgacgtcgcgctcaaggtagccgcgcacagggccctggcggacgcgtcaccgaccgtccagttcgccaacttcacgtccacgcaggcgctcctcgacgcgctcggcaccgcgcgccgcgtgcacgtcgtcgacttggacgtcggcttcggcggccggtgggcgccgctcatgcaggagctcgcgctccagtggcgccgagcacccgtctcgccgctgccgccgccgtgcttgaaggtgacggccttggtctcgccagggtcatcagcgcaccccttggagctccacctcacgcaccagggcctgacgcgcttcgccgccgacctcggcatctcgttcgagttcaacgccgtcgcgttcgaccccttggacccgttgccccccacggggctgtccgtcgcgcccggcgatgccgtcgccgttcacctctccgtcggctccggggtcccgtcggcagctactctccgcgtcgtgaagcagctccgccctgccgtcgtggtgtgcgtcgaccacggatgccaccgcggcgacctgccgctgtcgcaccacgcgctgagcgtcgtgcgctccagcgcggcgttcctcgagtcgctggacgcggccggggcgccggcggacgcggtggcgaggctggaggagtacgtcgtgcgtcccagggtggagcgcctgttgctaggcgacaggatgcctccatggcggaccatgcttgactccgccggattcgcgccggtgcagctcagcaacgccgccgaggcacaggccgaatgcctcgtcaggcgcacgcccacgccgggcttccatgtggagaagcggcaggcggcgctcgcgttgcggtggcaggactcggagctggtgatggtgtcggcgtggcggtgctgaatcggggcactgggacagttcctgtaaagattgaacctttttctgttctcatgtgcagtaaaattagctagtaacttgttgtcaagctgtttattttacaattttagttgcgatgatgtagcaattgggagcatgtgaattttcatcatctgtgatatgacagttttgaggaacgattggaagccac

SEQ ID NO: 281 - DNA, 1511 bp, Zea mays
cgctgtcccacggggcgatgaagacaacggctgcggaggcggcgcagcagcagttgctggacgagctggcggcggcggcaaaggccgccgaagctggcaattccattggcgcgcgagagatattggcgcggctcaatcaccagcttcccttgctcgggaagccgttcctccgctccgcctcctacctcaaggaggccctcctcctcgcgctcgccgaaggccaccacggcggctgccacctcacgtcgcccctcgacgttgccctcaagctcgcggcgtacaagactttctctgaccactcgcccgtgctccagttcaccaacttcaccgcgacacaggcacttatcgacgaaattgcccgcagcacatcgtcctgcatccatgtcatcgattttgatcttggtgttggaggccagtgggcttctttcttgcaggagctcgcacaccgccgtggcgcaggcggtgcggctctgccgtccgtgaagctcactgcctttgtatcagctgcttcccaccatccactggagctgcgtctcacgcgtgacaacattgcacagtttgctgcagaccttgggattccctttcagttcagtgctatcagcgctgatacgatcaaccctgcagagctcgtttctgccaccgctgatgaagttgtagctgttgtcctcccggttggttgctctgctcgtgcaccaccgctgccagcgatccttcggttggtgaaacagctggctcctaagattgtgatagccatagaccatggcgctgatcgtgctgaccttcccttctcgcagcacttcttgaattgcttccagtcctgcatgttcctccttgattcgcttgatgctgctggcattgatgctgattctacctgcaagattgagaagttcctgattcagccaagaattgaggatgcggtgcttgggcggggcaaggtggacaagccaattgcatggagaagtgcatttgcagctgctgggttcgcacctgttccacccagcaatttggcggaggcacaggccgactgcctcctgaagcgggtgcaggtccgcggtttccacgtggagaaatgcggggtcgggctcacactatactggcagtgtggcgagcttgtcactgtatcagcatggcggtgctgatcagcgatccacgcctgtgcgcaccatgttccaccaacatttgctggcatcttcaacccgagtaatgtgtattttgtcttgcaattaaatgctactaaggaaactgatatattgctgttgaaccctccatgttcatcatctttgcaacttacgagctagaactagtggatttttagcaatgttggtgccaatatctctagtgtaatgatgttggcctaagattttaccctgcttgctttcagctcactagacattcccatgtcatttggaacactgcttgtgaggagagggtataattaacctatcaaatgtctgtggtatagtactgatatgtgtttcatgtttctttatatcagtcattgttcttatggt

SEQ ID NO: 282 - DNA, 1936 bp, Zea mays
aagaaagaaagggaaggcggggggaggccggccaaggcaccaccacaccaccacccgacgaattcaagcatgaggccgccgccgccgccggcggccacgaccatgcgtttccacgacggtgccgacataaagcccccgcttctgggagtcccgtcggcaggtctacttcatcaacaccagacgctgccggcggcctccttcttcatgccgctcccctccttccccgaccatcagcaccagccacatctcccgcccccgccgaagcgccaccactctatgcccgacaacctgttcctcctccaaaaccagctccagccgccgccgtcgcagggtctaccattcccgccactgcataccaccacgcccttccagctccagccaccactgcaaccgccgcggggagcgatgaaaacaaccccggcggcgcagcaacatcaacagctcctggacgagcttgctgcggcggcaatggcggctgaggtcggcaactccatcggcgcgcgagagatattggcgcggctcaatcagcagcttcccccaatcgggaagcctttactccgctccgcttcctacctcagggaggccctcctcctcgcgctcaccgacggccaccaaggctccactcgcgtaacctccccgctcgacgtcgccctcaagctcggtgcatacaagtctttctccgacctctcgcctgtgctccagttcgccaattttacggccacacaggcgcttcttgacgagatcgcctcaacaacttcgtcttgtatccgcatcattgatttcgaccttggtgttggcggccagtgggcttccttcttgcaggagctcgcataccgccgtggaactgggaacggtcccctgccaatgttgaagctcacagccttcgtgtcaagtgcttcccaccacccgcttgagctgcatcttactcgggagaacctgtcgcaatttgctgtggaccttggcattccatttgagttcactgccatcaatctcgatgcgtttgatcccgcagagctcattgctcctagcgccgatgaggttgtcgctgtttgcctccccgttggttgctctgcacgcacgccaccgctcccgatgttgcttcagttggtgaaacagcttgctcctaagattgttgtggctattgaccacggcagtgaccggggtgacctcccgttttcgcagcacttcatgaattgcttccagtcctgtatgttccttctcgactcactcgatgctgctggcaccaatgcggatgctgccagtaagatcgagaggtttctgatccaaccgagagtagaggatgcagtgcttggccgtcggaaggctgaaaaggcaatggcttggcgggcagtttttacatcggctgggtttgctccagtgccactcagcaaccttgcagaggcacaagctgactgcctcttgaagcgggtgcaggtccgaggattccatgtggagaagtgtggaatgggtctagcactgtactggcagcggggcgagctcgtgtctgtctcggcgtggcggtgctgatcatagcaacctcatccgtcaaccatcgtcgtcgtcgcgcctacactattcgcaggcatgtttaactccggtaatatgcgttttatcttgcaaacattgcaaagaaactattgtcatggttgttccacgcctctgattgctttactgctgtttttggagtattagctaggcctaatgaatgttgcaatcttggtgtgggtgtccccctacaatgtaacatgttggtactagggtctcaacgctgttcgtgctctcttcttggttagccggaggctactttggcgtatttgtggcaatggtgttcgttattttactaggtaaatcagatgaagactgacatatgaactgaaatggttgggcattttttttctttcttggcttcatatccatggttgatgtatggatttct

SEQ ID NO: 283 - DNA, 905 bp, Zea mays
gattgatgcactcgctcatctcacatgggtgggactcttcgctcttgcatcactgcctgtctagcgggagctactctagcttccggacaccaactccagcgcccctgtatggaacaagtccaccctcactgtctgacagcgagctgcagataccctaatgaaggcagtgatggtgacaatgctccagaaacaagcagtgatgtaagcaatgagagtgacaatgacaatggaaggtctattggaagaacaacccaatgtttagcacaaaatatttgcaccgatcaagaaaggttgtccagtgatgactgtgattccagtaaccaggaacctccccctgttttccaatatatggagcatgatgcaccatatggaagacaaccattagcaaatatgtatttgcatgtaagtttcctgatctaaatacatacaagagctgtgatcttctcccgtccagttggatctctgtagcctggtatcccatataccggataccaacaggacctacgctacaagatctagatgcttgctttttaacattccattcactgtcaacaacacctgacggtgagtgctcgtgtttcttcttggataagacaagccgacgacctgcggcaagaaacagaagaaacaaagcgcccagattgatgtaacggctcagtagctcggtgagcccaggccggccttcaacaatggcatccagcgcaaagctgtggaaccggagagagtttctagggctgcatcgtcaacacgaacaaccaaaccagcaagaggcgttccgacaccaccacccttcccggactaggaaggagaggaaggttgccgtgaagctgtcgaggttccaaacagcagccgcttgagctcgtgcagaatcagggaagaaaactgttgttttgtcgtctgtctgc

SEQ ID NO: 284 - DNA, 996 bp, Zea mays
gtgccctgcaggtattcaacaattcccaacatttataattgatacgccgcctccatgcttcagttgctcaaattctctcattgtgcaactaggctgctcgaagggctgcagacagcgcctttcacctcccaagagtacaagagcaggtgaacaaggccgtcatggctgcaaacagagcggctacagctgcccgtgtcgctgcgatcaaggcagtgcagaacaggatagatggcaagctctgtttcatcgatgtgtgaattgggttcaagaattgtgcccttcacctgttaacaggatagactagccaagagcggcagtgactagctgctgagtttcgcgaccggagcagcacaaccgcatgctccgtgttggttggagagaccagtacggttggcggcagccaccaatgggctgaactgctgctgttttcttgaagtggttcacctcgtgctggatcgctgagagcaagttcaccctattctttttcctccttgtgcagactgctccatagtccatgtttccactccatccatgtgtatcaatggtggtgggtggagatgatctgtcagtgcttttttgttttttgcatcgccctgtactgtatgtgcattgtacatgcactgtgtttttttgctcggatcagatgttccgacggcaaatcttgccggtttgaacttgtggcgccacgtgcagggattctccatttgtatttgtacttgagggtgcacatgggtgtttaccagccaataatccctcgctgccatatcatgcagctttttttttgttgttccatccactgcacctgggctacctacctctctacctgcaccttttcggacatttccattttttccgcagattatggcgtctttcggtccacttgctgctccatgttctcgcctcgcattagaggcatgaagaaatgaaacatgcaagtgttgaggtaatgacaaatgcgttgcaatacactgggtccagtcacaccctttcaatttc

SEQ ID NO: 285 - DNA, 2439 bp, Zea mays
tctcctccagggatttgcccttggactccggcaccaggaacgtgaatgccaggcccagcaggttgcagccggcgaggaggaacagcgagttgcgcacgccgatgcccgcggggtacccgtggtccgtcttggccgggtcccggttctgcgccaggtacaggaacccgaaggagccgacgatggcgcccagcttccccgacgccgccgagatgccgtggcacgtcgaccgcagcctggccgggaagatctcagcgggcacgatgaacgtggtcgcgttgggcccgaagttggcgaagaagaaggtgaggccgtacatgacgatgaagccgatgtggtgccccggcgtcgtccagtgctcgtacggcacggccagcccaagcattgaagccgtagccgccgccgccggacgagacaggttgaggcggggcggcaatggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgaccaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgctccgtcgcgtcggggctctcgttcggccacaccccggcgtccgtcatggcgacgctgtgcttcttccgcttctggctcgggttcggcatcggcggcgactacccgctgtcggcgaccatcatgtccgagtacgccaacaagaagacgcgcggcgcgttcatcgccgcggtgttcgcgatgcagggcttcggcatcatggccggcggcctcgtggccatcgtcgtgtccgcgtggttcaaggccagtttccccgccccggcctacgccgtcgaccccgccgcgtccacgccgccgcaggccgacttcgtgtggcggatcatcctgatgctgggcgcgatgcccgcggcgctcacctactactggcgcaccaagatgcccgagacggcgcggtacacggcgctggttgccaagaacgccaagcaggccgcggctgacatgtccaaggtgctgcaggtggagatctcagccggcgccgccgaggagggcgccgcggctgcgactgcgactgcgactgagcctgcgccggcgtcggcgtccgcgtcttttgggctcttctccggggagttcctccgccggcacgggctgcacctcctgggcacgtccttgacgtggttcctgctggacatcgccttctactcgcagaacttgttccagaaggacatcttcagcgcggtggggtggatccccaaggcggcaacgatgaacgcgctggaggagctgttcagcatcgcgcgggcgcagtccctgatcgcgctgtgcggcacggtgcccggctactggttcacggtggcgctgatcgacgtgttggggcggttcgcgatccaggtgacggggttcctgatgatgacggtgttcatgctgggtctggccgtgccgtacgagcactggacgacgccggggcaccacatcggcttcatcgtcatgtacggcctcaccttcttcttcgccaacttcgggcccaacgcgaccacgttcatcgtgcccgcggagatcttcccggccaggctgcggtcgacgtgccacggcatctcggcggcgtcggggaagctgggcgccatcatcggctccttcgggttcctgtacctggcgcaaaaccgggacccggccaagacggaccacgggtaccccgcgggcatcggcgtgcgcaactcgctgttcctcctcgccggctgcaacctgctgggcctggcattcacgttcctggtgccggagtccaagggcaaatccctggaggagatgtccggcgagaacgacgaggcggccgccgccgccgccacgccgaactacaacaaccgcacagtgcccgtgtaagtagccgtagtagatgcatctgcatgcatgcatgcaaatgttatataaggaacaaagtacgtacgtaacgtaacgtgtcgtgtgtgtggctgttgcacggtagggtacacgcactgttctccttcgatctggtcgaggttgtttgtcgaggcacagccgtcgccttccgttacgtcattgttttccgttctctgtcttgtgcttgtgcatgttcggttgaacttgcgcgatcgatctgatgggatcagagacgtgctcctaaataaccggaggtcaccgtcggatatagacgtgctctcctggatgttgtaccaagcgcgtcacgctgctttattagatcaatcaagtactgttgttttcgtt

SEQ ID NO: 286 - DNA, 1646 bp, Zea mays
gatagaccacccaagcattgaagccgtagccgccgccgccggacgagacaggttgaggcggggcggcaatggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgttccgtcgcgtcggggctctcgttcggccacaccccggcgtccgtcatggcgacgctgtgcttcttccgcttctggctcgggttcggcatcggcggcgactacccgctgtcggcgaccatcatgtccgagtacgccaacaagaagacgcgcggcgcgttcatcgccgcggtgttcgcgatgcagggcttcggcatcatggccggcggcctcgtggccatcgtcgtgtccgcgtcgttcaaggccaggttccccgccccggcctacgccgtcgaccccgccggttccacgccgccgcaggccgacttcgtgtggcggatcatcctgatgctgggcgcgatgcccgcggcgctcacctactactggcgcaccaagatgcccgagacggcgcggtacacggcgctggtggccaagaacgccaagcaggccgcggctgacatgtccaaggtgctgcaggtggagatctcagccggcgcccccgaggaggacgccgcggctgcggctgcgactgcgcctgcgccggcgtcggcgtcctttgggctcttctccggggagttcctccgccggcacgggctgcacctcctgggcacgtcctcgacgtggttcctgctggacatcgccttctactcgcagaacctgttccagaaggacatcttcagcgcggtggggtggatccccaaggcggcgacgatgaacgcgctggaggagctgttcagcatcgcgcgggcgcagtccctgatcgcgctgtgcggcacggtgcccggctactggttcacggtggcgctgatcgacgtgttggggcggttcgcgatccaggtgacggggttcctgatgatgacggtgttcatgctggggctggccgtgccgtacgagcactggacgacgccggggcaccacatcggcttcatcgtcatgtacggcctcaccttcttcttcgccaacttcgggcccaacgcgaccacgttcatcgtgcccgctgagatcttcccggccaggctgcggtcgacgtgccacggcatctcggcggcgtcggggaagctgggcgccatcgtcggctccttcgggttcctgtacctggcgcagaaccgggacccggccaagacggaccacgggtaccccgcgggcatcggcgtgcgcaactcgctgttcctcctcgccggctgcaacctgctgggcctggcattcacgttcctggtgccggagtccaagggcaaatccctggaggagatgtccggcgagaacgacgag

SEQ ID NO: 287 - DNA, 1736 bp, Zea mays
gcagaggagaggaagaggagcttggggaggagatggccggcgccgagggcgagaggtgggtggggctagcaacggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgttccgtcgcgtcggggctctcgttcggccacaccccggcgtccgtcatggcgacgctgtgcttcttccgcttctggctcgggttcggcatcggcggcgactacccgctgtcggcgaccatcatgtccgagtacgccaacaagaagacgcgcggcgcgttcatcgccgcggtgttcgcgatgcagggcttcggcatcatggccggcggcctcgtggccatcgtcgtgtccgcgtcgttcaaggccaggttccccgccccggcctacgccgtcgaccccgccggttccacgccgccgcaggccgacttcgtgtggcggatcatcctgatgctgggcgcgatgcccgcggcgctcacctactactggcgcaccaagatgcccgagacggcgcggtacacggcgctggtggccaagaacgccaagcaggccgcggctgacatgtccaaggtgctgcaggtggagatctcagccggcgcccccgaggaggacgccgcggctgcggctgcgactgcgcctgcgccggcacgggctgcacctcctgggcacgtcctcgacgtggttcctgctggacatcgccttctactcgcagaacctgttccagaaggacatcttcagcgcggtggggtggatccccaaggcggcgacgatgaacgcgctggaggagctgttcagcatcgcgcgggcgcagtccctgatcgcgctgtgcggcacggtgcccggctactggttcacggtggcgctgatcgacgtgttggggcggttcgcgatccaggtgacggggttcctgatgatgacggtgttcatgctggggctggccgtgccgtacgagcactggacgacgccggggcaccacatcggcttcatcgtcatgtacggcctcaccttcttcttcgccaacttcgggcccaacgcgaccacgttcatcgtgcccgctgagatcttcccggccaggctgcggtcgacgtgccacggcatctcggcggcgtcggggaagctgggcgccatcgtcggctccttcgggttcctgtacctggcgcagaaccgggacccggccaagacggaccacgggtaccccgcgggcatcggcgtgcgcaactcgctgttcctcctcgccggctgcaacctgctgggcctggcattcacgttcctggtgccggagtccaagggcaaatccctggaggagatgtccggcgagaacgacgaggcggccgccgccgccgccacgccgaactacaacaaccgcacagtgcccgtgtaagtagccgtagtagatgcatctgcatgcatgcatgcaaatgttatataaggaacaagtacgtacgtaacgtaacgtgtcgtgtgtgtggctgttgcacggtagggtacacgcactgttctccttcgatctggtcgaggttgtttgtcgaggcacagccgtcgccttccgttacgtcattgtttcctttctgtctggtgcttgtgtgcatgttcagttgaacttgcgcgatcgatctgatgggatcagagacgtgctcctaaa

SEQ ID NO: 288 - DNA, 795 bp, Zea mays
gaagccgtagccgccgccgccggacgagacaggttgaggcggggcggcaatggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgttccgtcgcgtcggggctctcgttcggccacaccccggcgtccgtcatggcgacgctgtgcttcttccgcttctggctcgggttcggcatcggcggcgactacccgctgtcggcgaccatcatgtccgagtacgccaacaagaagacgcgcggcgcgttcatcgccgcggtgttcgcgatgcccgcggcgctcacctactactggcgcaccaagatgcccgagacggcgcggtacacggcgctggtggccaagaacgccaagcaggccgcggctgacatgtccaaggtgctgcaggtggagatctcagccggcgcccccgaggaggacgccgcggctgcggctgcgactgcgcctgcgccggcgtcggcgtcctttgggctcttctccggggagttcctccgccggcacgggct

SEQ ID NO: 289 - DNA, 816 bp, Zea mays
gggggatattgggccgggctacagacatcaggcagctctcccgagcatgacatcgtttctgttcacaactcttccgagcatgccgtcgtctcctttgtcatcatcatcagctcagatctagcaacttcgccttctcaggtaagggctctgctcacatcttcatatccctgctactaggttttcgtcgtttatcctcgctcggattcttgtagatctcgctcaccttgtagatctcgctcagattcgtttgtcctcgccagacgcgctcacttcgcagctgccgctgtgcctatgctactgcatgggcctctgcgcctgggaggcttgcggcttccaggcttaagtcacgggacagcaggacttcagatttttttaggtctttgaaacaaggctagcgcacattagaatcgagagtctcagtacgaatgggaagtaccgtcataaatttatctttgctactagcaataggaagcaccgtcataaaattaactctggtaataaaatcgattggatatatattgtttctaggaaactaggaaggatcccgtgtagaaagtgtggctagctatcctttttcattggatcatttggctttttcttaaaatatttcttccaaaacagtctcacttttttcttaagttgtattggtgctccctaaggtcgaaagcaggaatattacttttctgcaaaatcacaaaaatgcacacatttgggacttttcctaagctgtgtcttcgagcaaccaaaaagctgatgttaatttattttcatttttttaagagaagaaaattctttggatgaaaatattgatcattt

SEQ ID NO: 290 - DNA, 704 bp, Zea mays
gagcaagtcaggagaaacaacttgttgattttgcaatgagacacctgtatcaagccagcaaccgtctccctttcacaatacaaacactcatcaccactcgagcactccacacagaagagcaagcacgcaaacgacaagctcttttcatatctacaggaagcttatctttgggtcaaggctaggggtttctgtatacaccaattgcggcgagcaggggccgcttctatggttgatatgcactcaaacaattacacgaatcagctacactcagtgaggtcgaccgagcagattaggaaacgcttcacacccaacaaatggttacagctttttattacctgtaggcacagtctccggtgagaaaacatgaggccgtgtgatgttgttagtgaccacccaatgtggcgagggcaaactgatctacaactgtgccaggctctgcttttggtttcgctgtagcatatgagtttgcaaactgcagttttttacatgtattgctgcaaccgtggacaagagatcctttgattggtccaacaacatttgttcttgtgttgcaagtttagaaagctcagacaccacagagcttgttccctcgaccttagacagcaaattacatattgatgatgtcattgtgttcattacatccactgctgagttaactgcttccttcacagctagtgcatcagcctttgcaccatcaacaactg

SEQ ID NO: 291 - DNA, 684 bp, Zea mays
tgcatcaccgctcacaccatatccttctccatcatcttcaccggcaccggctgacagacactacctaaaatggtggtccgctttcgcccgttacaacaacaaccaaaaaaaaaaaaccccgcagctacctacaatgaattacgtacacacaaataaaccgtgggacaatgtacaaacaacaaccaaaatggtttgatctattatatagcagcttctgctgctgcttcctttttttattttgtgtgtgtgctagaaagtggcgttccacagcgccttctcgccttcagcgcacttattgtggacctcccagatccttccctcggagttgcatatgccgctgcacctccagtcgaacgacgcggcgcaaacgttccccgcctgagctttccattcgcaatctgtggttaaaggctttcataagatgaggctccatgaaaaatagttggcattgttcagcagcaggttcccggccaaagccatgtttcaaaagaacaattcagatggcgcggcctcgtgaatgatgaacaaacaagcttgagtgtgtcagtcaggggcatgaagtgatgaaaaaactcaccaggcggagtgccacagcaagtctccggtcatcgatatgctcaacatctagcccgatgaaccaagatcctaacgaaacgtcttcgtttatgtactcccaacacaatg

SEQ ID NO: 292 - DNA, 1525 bp, Zea mays
ccccaccacgcacgatggccgccgtaaggtcgctgctccgctcgtcggcctcccttcttcgcgccgcccccgccctcgcgagatcctcggctaccacgcgtccgtctcttcggcgcgcattggctgctcctcctcgccttctccggtcgcccgtcgagtcgagcttctgcgtggagtcgcttctgcctctgcacaccgccaccgccggtgcacgcatgacgtccatgctcgccgctcctggccaaggcctcggctggctcacccaaggtaaaaaaaaacagttacttcgatctactacaatgacactttaaattcagactcagaggctgctctgcttttggcaagctccgcagtgtaaatgtgtaattacctggttggcatagctgatgccgcttcgtttgtgcttccatcatttcggttattgtgtgtaattccatgattgcatcgttcgccagtcctgtttctagtttgtctatttggaagagagtcatttcctatatttctttttcatttctttctgtaggatctgatgaaactagatgaagagcagccggggaaaggtgaccactagaatacctccaacagtttcgtttaattgctatttgctatggagttgaatcttacaccacaaataaccttagatgactacgaaccctattctgacttgtgaatatgaaatagcccaaccaattaataaaattgttcaacgggatacctggttttcaaaagtaggcataggtggaggataaccgttgccccacaaacatatctaccaatgacctttcagagtgttgtgtccccaagaaaggatggtatccgtatgcattaccagaagatgtgctgttaaatacagtgtgtaagactcccagatggctaaatccatttggaagaatgcattgacatcatttataaaatggggtttagtacaaaattgaataaaatggttttatagatgttccaaattaactggtaagaggaaggaatattgatgtgagaaatactgcaaggattgaactatatgctaaagcagtctggaagaaaaatgttttctatagatgtttttaatacttcgtagcactttcctttgatgtaagagtccctgaattgttttctatgttttatcagttattttattagaatattagtgaatagggcagttagctttgaaaaatcgaatgtgctaaagttgggggtactgcataagttttctagaatcttagagaagctttgatgaattaatctttttttttgtactacagcggaaactgacggagtataaccccccccgggggggctcccctttaggaaccaggacatcaattgtgcttcgagtttttctgtgcctggaggaaacaggaagagttgattggaaaaagaaaaaatgggaggggtttttctttttgttcatgtgaactgagatacgacttaataaactagattttggaatgatgttttgcccccccccccccctttttttaatgttttttcattgactaaaacggttatgtaatgataactatgtgac

SEQ ID NO: 293 - DNA, 571 bp, Zea mays
ggccgccccaccacgcacgatggccgccgtaagggcgctgctccgctcgtcggcttcccttcttcgcgccgcccccgccctcgcgagatcctcggctaccacgcgtccgtctattcggcgcgcattggctgctcctcctcgcctcctcaggtcgcccgtcgagtcgagcttctgcgtggagtcgcttctgcctctgcacaccgccaccgccggtgcacgcatgacgtccatgctcgccgctcctggccaaggcctcggctggctcacccaagctgaaactgacggagtataacgccccctgcgggtactttaggaaccaggacatcaattgtgcttcgagttcttgcgtgcctggaggaaacaggaagagttgattggaaaaagaaaaaatgggatgtgtttttctttttgttcatgtgaactgagatacgacttaataaactagatcttcgaatgatgctctgaccccccccccttttttattgttttttcattgactaaaacgggtatgtaatgataactatgtgacacttggtttgtttggtgtgattcttcagcggagcctggtgag

SEQ ID NO: 294 - DNA, 368 bp, Zea mays
gtcgagtcgagcttctgcgtggagtcgcttctgcctctgcacaccgccaccgccggtgcacgcatgacgtccatgctcgccgctcctggcaaggcctcggctggctcacccaaggatctgatgaaactagatgaagagcagccggggaaagctgaaactgacggagtataacgccccctgtgggtgctcccctttaggaaccaggacatcaattgtgcttcgagttcttctgtgcctggaggaaacaggaagagttgattggaaaaagaaaaaatgggatgtgtttttctttttgttcatgtgaactgagatacgacttaataaactagatcttcgaatgatgctctgaccccccccccccctttttt

SEQ ID NO: 295 - DNA, 763 bp, Zea mays
ccggaaaaccccatctcccccgccgccccaccacgcacgatggccgccgtaaggtcgctgctccgctcgtcggcctcccttcttcgcgccgcccccgccctcgcgagatcctcggctaccacgcgtccgtctcttcggcgcgcattggctgctcctcctcgccttctccggtacggccccgcccgccgctactctgctgcctgcctgcttcctgatactgtagtaagcaagacacagagttgtggacgactggcgcggtggtgatacgcttgttactctcccaggtcgcccgtcgagtcgagcttctgcgtggagtcgcttctgcctctgcacaccgccaccgccggtgcacgcatgacgtccatgctcgccgctcctggccaaggcctcggctggctcacccaaggtaaaaaaaaacagttacttcgatctactacaatgacactttaaattcagactcagaggctgctctgcttttggcaagctccgcagtgtaaatgtgtaattacctggttggcatagctgatgccgcttcgtttgtgcttccatcatttcggttattgtgtgtaattccatgattgcatcgttcgccagtcctgtttctagtttgtctatttggaagagagtcatttcctatatttctttttcatttctttctgtaggatctgatgaaactagatgaagagcagccggggaaaggtgaccactagaatacctccaacagtttcgtttaattgctatttgctatggagttgaatcttac

SEQ ID NO: 296 - DNA, 438 bp, Zea mays
accagggaggctaggctccccaccaagattctgtggatgaggaggatgcgtgttctgaggcgcctgctccgcaagtactacgccgtagcaccagcctccgctttcctcttgcgaatccacctcgggctaacctcgatgagcctgtgaggcataagctgctgctccttcctggtcagcttcttgtagttgctcaccctgagtttggcgatctttgcctcctcctcagctgtagcctctctaaccaccactgtcaatctgcacctgggtcgcaccataatgccggacctccctctggcatggtaagacactctcttcaggaaaagtccctttcccacaaaggcctcctcaacaatgagcttatcaggatccaatccatggttgtgagatgcattggcccgagcagaatggatcacctggtaaacggttttggcagccctt

SEQ ID NO: 297 - DNA, 1305 bp, Zea mays
  misc_feature (1305)..(1305): n is a, c, g, or t
caacctcccagccgtcgctagtcgctcgctccatcaccgataaccaagatcccaagacctcctccagcctcctctgctctcgcgccggcacccgcacgcatggctgcctgtgtcgacaagtggcaccccacgcacgccggccgcctcaccggcgccatctaccgctacttgccggacggcgccacggaccgcgcggtggccgccgccgccgccgcgccggcgtccgcgagcggcggcgacgacgacgacgtctgggacgagctgcgcgcggaggcgcaggccgacgcggacgccgagcctctgctccgcaagtactacgccgacctcgtcctgtcgcgcccgtcgctggaggccgccctcgccgcgcacctgtcggccaagctctgcgtccccggcgcgctgccgcaggacgcgctccgggacctcctggccgccgcactggccgcgcgcccggagtccggccgcgccgcgcgcgccgacctccgcgcggcgcgcgaccgcgacgcggcctgcggccggatggtgcactgcttcctctactacaagggcttcctcgccctgcaggcgcaccgcgccgcgcacgggctgtggtgcgagggccgctccgcgccggccttcctcctccagagccgcgcgtccgaggtgttcggcgtcgacatccaccccggcgcgcgcattggctcggggatcctgttcgaccacgccacgggcatcgtcatcggcgagacggccgtcgttgggaacgacgtctccatcctgcacggcgtcaccctcggcggcacgggaaaggagtccggcgaccggcacccgaaggtcggggacggggtgctgatcggcgccggccccagcgtgctcggcaatgtgcgcgttggagccggggcgaagattggagcaggggcggtcgtgttacgggacgtgccggaggggaccacggccgtcgggaaccccgccaaggcggtcgggaagaaggcggcgccgcagcggcggccggaagagcagcctggggtcaccatggagcaagggtggtcggactacgtgatttgataacttccagagggtctgtttgcaaatatttagtgcaggagagtttccctcccagaagatatttagtcaagtcgttattgagagataggtgcattgccgttgctgcattgcataaagagggagctcaattaggcattgagccctagagcaactccatatttttctttgttttgcgtgaggggaataacaatactatatgcatctgataagttatcggttgcttgtacatatactttcaagctataaattattgtgtccgcn

SEQ ID NO: 298 - DNA, 1423 bp, Zea mays
gcctccgcaatcgacaacgaaccactgggcaccggccgcggctcgcaagtggcctgcgttcctcttccacgctccgcccacccgtcccggggcccgccgcaacccgatccctccccgcgcccaacgatgccggccggccagccgcacgcgcacgaagccgctgccgccgcctgcgtcggcagcggcgcgaaccactccaaccaccgagtgccggcgcactcgccaccgccgctccccgcggaggtggtgccggcgtacccgcccccggagtcggaggacgacgagacctgggtgtggacgcagatcaaggcggaggcccgccgcgacgcggacgcggagccggcgctcgcctccttcctctacgccaccgtgttgtcccacccgtccctgccccgctccctctccttccacctcgccaacaagctctgctcctccacgctcctctccacgctcctctacgacctcttcctcgccacgctcaccgcgcacccctctctccgcgccgccgtcgtcgccgacctcctcgcggcccactcccgcgaccccgcctgcgtcggcttctcccactgcctcctcaactacaagggcttcctcgccatccaggcccaccgcgtcgcgcacgtgctctgggcgcagcagcgacggcccctcgcgctcgcgctccagtcccgcgtcgccgacgtcttcgccgttgacatccaccccgccgccgtcgtcgggaagggaatcctcctcgaccacgccaccggcgtcgtcatcggtgagacggccgtcgtcggcgacaacgtctccatcctccaccacgtcaccttgggcgggaccgggaaggcggtgggtgaccggcaccccaagattggggatggcgtgctgattggagcaggggccaccattcttggtaacgtgaaaattggtgccggggctaagattggagccggatccgtggtgctgatagatgtgccggcgaggagcacggcggttgggaaccctgccaggctgattggtgggaagaaggccgagggtgcgaatgaggaggacatgccaggggagtccatggatcacacgtccttcatacgtcaatggtcggactacaccatttgagagcggttatccaaggtctattgctcttcttttgtatcactagtaatggtgatgtaccaaataccgagtacttgctctttgttgtgtgctatggtttgtgtattgtacttagaagcctagtggtgtttatgatcattgtcagctgagtgtgccatgcctgaatactggtaaatttcgattgatggatggacaaatctgtatgagagttggttggaatttgtcacattccttatgaaacaaattctgaggacagaatgaagcgtgtaaagcgattatcttatttgatgcagtttttgttatttgatattatgccatttattttttg

SEQ ID NO: 299 - DNA, 879 bp, Zea mays
  misc_feature (10)..(10): n is a, c, g, or t
  misc_feature (733)..(733): n is a, c, g, or t
  misc_feature (829)..(829): n is a, c, g, or t
  misc_feature (844)..(844): n is a, c, g, or t
  misc_feature (862)..(862): n is a, c, g, or t
ttccgtccgnattcccgctcgacccagcgtccgccggccgcggctcgcagtggcctgcgttgctctggcacgctccgcccacccgtcccggggcccgccgcaacccgatccctccccgcgcccaacgatgccggccggccagccgcacgcgcacgaagccgctgccgccgcctgcgtcggcagcggcgcgaaccactccaaccaccgagtgccggcgcactcgccaccgccgctccccgcggaggtggtgccggcgtacccgcccccggagtcggaggacgacgagacctgggtgtggacgcagatcaaggcggaggcccgccgcgacgcggacgcggagccggcgctcgcctccttcctctacgccaccgtgttgtcccacccgtccctgccccgctccctctccttccacctcgccaacaagctctgctcctccacgctcctctccacgctcctctacgacctcttcctcgccacgctcaccgcgcacccctctctccgcgccgccgtcgtcgccgacctcctcgcggcccactcccgcgaccccgcctgcgtcggcttctcccactgcctcctcaactacaagggcttcctcgccatccaggcccaccgcgtcgcgcacgtgctctgggcgcagcagcgacgggccctcgcgctcgcgctccagtcccgcgtggccgacgtcttcgccgttgacatccaccccgccgccgtcgtcgggaagggaatcctnctcgaccacgccaccggcgtcgtcatcggtgagacggccgtcgtcggcgacaacgtctccatcctccaccacgtcaccttgggcgggaccgggaanggcggtgggtgaccngcacccccaaaatggggnatgggcgtgctgatgga

SEQ ID NO: 300 - DNA, 761 bp, Zea mays
ggccgcggctcgcaagtggcctgcgttcctcttccacgctccgcccacccgtcccggggcccgccgcaacccgatccctccccgcgcccaacgatgccggccggccagccgcacgcgcacgaagccgctgccgccgcctgcgtcggcagcggcgcgaaccactccaaccaccgagtgccggcgcactcgccaccgccgctccccgcggaggtggtgccggcgtacccgcccccggagtcggaggacgacgagacctgggtgtggacgcagatcaaggcggaggcccgccgcgacgcggacgcggagccggcgctcgcctccttcctctacgccaccgtgttgttccacctcgccacgctcaccgcgcacccctctctccgcgccgccgtcgtcgccgacctcctcgcggcccactcccgcgaccccgcctgcgtcggcttctcccactgcctcctcaactacaagggcttcctcgccatccaggcccaccgcgtcgcgcacgtgctctgggcgcagcagcgacggcccctcgcgctcgcgctccagtcccgcgtcgccgacgtcttcgccgttgacatccaccccgccgccgtcgtcgggaagggaatcctcctcgaccacgccaccggcgtcgtcatcggtgagacggccgtcgtcggcgacaacgtctccatcctccaccacgtcaccttgggcgggaccgggaaggcggtgggtgaccggcaccccaagattggggatggcgtgctgattggagcagg

SEQ ID NO: 301 - DNA, 1464 bp, Zea mays
cccgctgcccgcccacgacatggacatggcctcgccggcgctgctcaccgacgacctcctgtcggacatcttcctccgccttgcggagccggccgacctcgttcgcaccgcagccgcctgcgtccccttccgccgcctcgtcgccgaccgcgcgttcctccgccggtaccgttcgctccaccccgcgcctctcctcggcttcctcgaccacaacggcttccacccggcgctcccgccccacgcatccgcccccgcggcgcgggccgtctcgctcgcagcggatttctccttctcgttcctacccgcctcctccacgggccgcggctgggtcgtccgcgacgtccgcgacggccgcgtcctcctcgaccgctcccccgaggacagaggcgacgagccgcaggtcttcacggagatagcggtgtgcgaccccttgcaccggcgctgcgtcctgctccccccggtccccgtcgacctggccacagcggtggagcacccgctccgcttggagttcgaccgctggtgcgagcccttcctcgtcccccacggcgccgacggagaggatgagacgtcgttcgaagtgatctgtatggtgcagtgcaaagccaagctggtcgccttcgccttctcttccaccactggggaatggcgagccgtcgcgtccatggcctggcgcgacctgatggccggcctgggcgtgtcgtcaaggagccctacgtttctccggccgccagtacgctcgcggctgcttctactgggttatggattggcgagacaagttgctcgtgcttgacgctgggaggatggaattctccatcgctgacgtcccacctagctgccataggcgacagatcgcagttgtggaagcaggggaaggcagggttgggatgttggcgctccgcgaccacgttgcagatggtgcagttagcctccattatactgtaaggcgagacgatgccgacggttccaattccaaccagtggcaggtggagaagataattccgctggatcctggatttcggtattacatcaggggtgcgatggagaggtacacgctcctgctaaggtttcctgaacacctaagcttagcaggggtgcatgtaagctcatcggcagtgatagaagacttggaatgtttttccatggacaccaagactttgcagcttgagagggtgtgcgaattgaaccaccacattatgcgtgcctacgtatataccaacttcccaccatccctgtcgccacagagtatttaaatgggtaaactccttccacaaacatgtaatgtatccacatccttcttctttctcatgctattcctattgacatggtaaatttgttagtgacaaacggacaatcttgtctattcaaattttagtagtgttgttttattgtttatgtggtttgtagcttttcttaccacatagatggaaccattaacgtttttatttgatgatcgtcagtgaaatg

SEQ ID NO: 302 - DNA, 815 bp, Zea mays
gctaagccgaatcgagcagcagtagccaccttgccatggcgatgcaggctgctttcctcgcggggttctcgcagctcgccgcgcagccgagccgcgactgcgccgtggcagtggcgccgacgcgggtggccgttgctgcggtgggtagcgccaaggtgggcgcgcgggtaggcttgaaggcggggatcgccgcgcccgcgcccgcggcgggccgcggggtgcggtgccgcgcaagcctgatcgagcccgacggcgggcagctggtggacctagtggcgcccgaggagggcgggcggcgcgcggcgctccggcgggaggcggcggaactgccgcaccggctgcgcctcggccgcgtcgacaaggaatgggtccacgtcctcagcgaagggtgggcgagtccgctgcaagggttcatgcgcgagcatgagttcctccaaacacttcattttaatgccatccgcggccaggatggcaggatggtcaacatgtccgtccccatcgtgctctccgtaggggacgcacagcgaagggccatccaggccgacggcgccacgcgcgtcgcgctcgtcgacgaacgcgaccgccccatcgccgtcctcagcgacattgagatctataagcataataaggaagaaagaatagcacggacatgggggacaactgcacctggattaccttatgttgaggaggcaattaccaatgctggtgactggttgattggtggggacttggagattatagaaccaatcaagttcaatgatggtctagatcagtatcgcctgtctccagcacagctgcgtgaagagtttgccagg

SEQ ID NO: 303 - DNA, 1926 bp, Zea mays
ccgcctttcacaaaaccaaacaaaacgcacccgcaatataaagaggagaccaaggcgtgaagtggaggaggcagaggtggacgaggcgcgccaccgcccgagccgaatcgagctgcagaaaccaccttggcatggcgacacaggccgctttcctcgcagggttctcgcagctcgccgcgcagccgggccgcgaccgcgccgtggcggtggcggtggcgccggcgccgggcccggcccgggtggccgttgcggcggtgggtagcgccaagttgggcgtgaaggcggggacgtccaggaccgcggcggtggcgcgcctcggggtgcggtgccgggccagcctgatcgagcccgacggcgggcggctggtggacctggtggcgcccgaggagggcgggcggcgcgcggcgctgcggcgggaggcggcggagctgccgcaccggctgcgcttgggccgcgtcgacaaggaatgggtccacgtcctcagcgaagggtgggcgagcccgctgcaagggttcatgcgcgagcatgagttcctccaagcacttcatttcaatgccatccgcggccaggatggcaggatggtcaacatgtccgtccccatcgtgctctctgtcggggacgcacagcgaagggccatccaggccgacggcgccacgcgcgtcgcgctcgttgacgagcgcgaccgccccatcgccgtcctcagcgacattgagatctataagcataataaggaagaaagggtagcacggacatgggggacaactgcacctggattaccttatgtcgaggaggcaattaccaatgctggtgactggttggttggtggggacttggaggttatagaaccaatcaagtacaacgatggtctagatcagtatcgcctgtctccagcacagctgcgtgaagagtttgccaggcgcaatgctgatgcagtatttgcctttcagcttcgcaatcctgtacacaatgggcatgctctacttatgaccgacacacgcaaacgcctccttgagatgggttataaaaaccctgttcttctgctccatccactgggaggattcacaaaagcagatgatgtgcctcttagttggagaatgaagcaacatgagaaggttcttgaggaaggtgtcctcaacccagaatcaactgttgttgcgatcttcccctctcctatgcattatgctgggccaactgaggttcaatggcatgctaaggctcgtattaatgctggtgcaaatttctatatcgttggaagggatcctgctggtatgagccaccccacagagaaaagggacctctatgatgctgatcacggaaagaaggttttgagcatggctcctggccttgagaggctcaacatccttcctttcaaggtggctgcgtatgacacaaagcaaaagaaaatggatttctttgatccatcaaggaaagatgatttcctcttcatctctggcacaaagatgcgcactcttgccaagaaccgagagagtcccccagatggttttatgtgcccgggtggctggaaggtactcgttgaatactatgacagcttggtgccatctgagggcagcagcaagctgcgtgaaccaattgcagcctaaaatctggaaaatccttcatataaggaatgctactatatcttagcaagcggttctttgcgacatagaaccgatgctatatgattgtatactggctgtaagactgtaaaacactaggcttgattcggatgttaatgtgtgctttgtacccggtgtaccttctctgctggcagtgttgcacatgcactggagcacatcaaacgtttggtgttaataaggacaggctatgtatcctctgccagattgtacatatatacattgtggtgatatataattataaagctgacctctgccgtccgggctcgtagtgatgaacagttttatcact

SEQ ID NO: 304 - DNA, 870 bp, Zea mays
  misc_feature (1)..(3): n is a, c, g, or t
nnnaagaatggtagcctgcagtacggtccggaattcttcaaaagaggcagcgtccgcgaggcgctttcacggacgagccgaatcgagctgcagaaaccaccttggcatggcgacacaggtcgcttccctcgcggggttctcgcagctcgccgcgcagccgggccgcgaccgcgccgtggcggtggcggtggcgccggcgccgggcccggcccgggtggccgttgcggcggtgggtagcgccaagttgggcgtgaaggcggggacgtccaggaccgcggcggaggcgcgcctcggggtgcggtgccgggccagcctgatcgagcccgacggcgggcggctggtggacctggtggcgcccgaggagggcggacggcgcgcggcgctgcggcgggaggcggcggagctgccgcaccggctgcgcttgggccgcgtcgacaaggaatgggtccacgtcctcagcgaagggtgggcgagtccgctgcaagggttcatgcgcgagcatgagttcctccaagcacttcatttcaatgccatccgcggccaagatggcaggatggtcaacatgtccgtccccatcgtgctctccgtcggggaacgccagcgaagggccatccaggccgacagggccacgcgcgtcgcgctcgttgaagagcgggaccgccccatcgccgccctcagggacattgagatctatatgcataataaaggaaaaaagggaagcaagaacatgggggaaaactgcacatggataacctaatgccaaggaagcaataaccaaggcggagaatgggtggctggcggggaattgaagagtataaaacactcaagcaaagagatggagccaataaggatcgcctggacccacgcaac

SEQ ID NO: 305 - DNA, 1537 bp, Zea mays
caatccacattccccaccccccacggcccccgggcccacccaccctctccctcttcttcctcactcctctctccctctctctctctctctctctctctctcgtcctgcgccacacgccgcggccgtctccgggcaggaaggaagggggcgggaagatgatgatgacgcgggcaccgatggggccgatggagggcgcggcggtggacgagatggtgcgccgcctcgtggagggcggccgaggcgggcgccaggtgcagctgtccgaggcggagatccggcagctctgcgtagagggcaagcgggtgctcctctcccagcccaatctcctccgaatccacgccccagtcaagatctgcggtgatatccatggccagtttgtcgaccttctgagattattcgatttgggtggttatcctccagcttcaacttacgtattcctcggagactatgtcgatagaggcaaacagagcctggagactatatgcttgctgctggcgtacaaaatccggtaccccgaaaatattttcctgttgaggggtaaccacgaggatgcaaagatcaacagagtctatggtttttatgacgaatgtaagaggaggttcaatgttcggctgtggaagatattctctgattgcttcaactgcctgcccatcgcagcgctcatcgatgacaagatactgtgcatgcatggtggcctctcgcccgaattgactagtttggaccagataaaagatattgagcgacctgctgagattcctgattatggtctcctgtgtgatctgctttggtctgatcctagccccgatggagaagggtggggggagagtgacaggggtgtctcgtgtacgtttggtgcagataaacttgtagagtttttggagaagaatgatctcgatcttatatgccgagctcatcaggtggttgaagatggctatgagttctttgcacaacgaagattagtgacaatcttttcagctccaaattattgtggagagtttgataatgttggcgctcttttaagcatagatgagagcctaatgtgttcatttcagatcctgaagccaactgatatgggtccaccgcatgcaagaaaacaaattccaaataagccaacaagagggtgaagccttggaccagcatccaatacttccagttccagtatcatgatgatcgtcagtcagctcaaagggggtgatctgttgtttggatagttggatccaccagggcctgacattagacatccatcagccaattaatccctttagccaccctttactcgtgtcttgggaggcggcttggctgtaaaggatattctgtacagcatttagttggattcaacacatcatctgttttactgttcttcctgccggcaagggacctcattggcagcatgacatacaatagatgttagtagtctcaatttgttttccttagcttttgccttgcgtttttttttttttggtgcgggacttgatgtatggtgattttatatctttgtaatatgtagatgttgcaggaaataggtttgcccaacccc

SEQ ID NO: 306 - DNA, 839 bp, Zea mays
cctctccctctctcccaccccgcagccgccgcgcaggtagccctagcacccgcgacgagcaggatctgcccaggtaaatcgtcttcaagccggatgcatgccggcagctagtttcttctctgtcccttattccccactccaagtgtttgtctggtcagtaggtaagattacggatggggatccagcacctaccgcacctgggctggttttctagtctggaaggagagcaccatgacacgctcgtgctggaatatagtgcgattttatgttcctgctacgttgcgactgctcatagaatatatgccaattttcatcttcctgctatgtccgtgtatcatgttttttgaaaaataatatctccatatccgcatccttctgataccgcccatatccatgcatacatatggtttgcttgctatatgcaagcgcctcgaacccggattgctatattttgatgatttcgtgtctctcatttgatctttttttaaagaataagttggtgccgtgattgtagatctaagatcaacgtggttgcaacctgtgttcaactaagacacatcgttcccagtttacttttttcttagcttttgtgcttgcaatcctgtgaagtgtgacgtaactaatggaatagtgtatcctgacaaataatgcatggtgaaacgttttttatccagattccttgaatcctctaaattgtgtttgtttattggtagaaatgaacttcatctaccaaacaggattcgaacatgcctttctttaccatgtttcgtgcaactatgcactgctaacatatcagtaccatggtttgcacctgctagaatatcagtttattaccgttt

SEQ ID NO: 307 - DNA, 814 bp, Zea mays
  misc_feature (789)..(789): n is a, c, g, or t
gcagatctgcccaggtaaatcgacttcaatccggatgcatgccggcagctagtttcttctctgtcccttattccccactccaagtgtttgtctggtcagtaggtaagattacggatggggatccagcacctaccgcacctgggctggttttctagtctggaaggagagcaacatgacacgctctacgttgcgagttgcgactgctcatataatatatgccaattttcatcttcctgctatgtccgtgtatcatgttttttgaaaaataatatctccatatccgcatcctcctgataccgcccatatccatgcatacatatggtttgattgctatatgtaagcgtctcgaacccggattgctataatttgatgatttcgtgtctctcactttatcttttttttaaagaataagttggtgccgtgattgtagatctaagatcaacgtggttgcaacctgtgttcaactaagacacatcgttcccagtttacttttttcttagcttttgtgcttgcaatcctgtgaagtgtgacgtaactaatggaatagtgtatcctgacaaataatgcatggtgaaacgttttttatccagattccttgaatcctctaaattgtgtttgtttattgttagaaatgaacttcatctaccaaacaggattcgaacatgccttttcttacccatgttttgtgcactatgcactgctaacatatcagtaccatggtttgcacctgctagaatatcagttattacggttttgggtgcatcgtgactgaagtggatggggttattngaacacgtatttgaatatttgatgt

SEQ ID NO: 308 - DNA, 456 bp, Zea mays
acactgtaataaattatacgaaacttgtacaagtcaaattcaaaggaaattatttatatatatttccacatatttatatatatacgacaaattagaaagcacactacacagaacaagagaaatctacggtaccgggctgggaagaataagtggtaagcagtcgtgctcctcctcccgtcctatcccctttccttccctttctttctccctcgcacaaatccttgcgcccgtctcctcccagcaacgtggaagaagaagaaatggatgtagcagcggatcttgtgagagtatcacaggagcaggcagcgacggtggattgtgcgatggcggcgcctccgatcgtcgctctgcacccgcgtggagaacagctgggtggagccgcgcggtggacagttaagacactaccgtcgtgtcgagggatctgacaagcggcggttaagacgggaggcgggatgg

SEQ ID NO: 309 - DNA, 906 bp, Zea mays
gccccagctcagcagctatatggagtggagtggagtggagcatggaggggagggaatccgcttttcctggagcaggttcaaacggcagccatggatggaggggccaactagtgcggccaatcggctactttgtctcttccccacctcctcttgacttgatccccgagcatatattcctggacacctaatcactggatttctagcctctagtgttcatcaaggactccactcgcatcacctcacatacacaggaggccgcatgtaacaggggaagtccggcgtagtttcttgagagaaaaaaaggagtcccctctaccaagcaatctacctacacaagtagaccaatcaacggtcgtcctacagttgggcgagccaaatctaagacaaaacctacaaccaatgtgagcccgtggtaggctagcggtaaaagaagccgaaccaataatccacctaggcatggtttccccgtgatccatccgagtggcatcatgaccggcaaattttgcaccccgcaccacaaaaacggagatgtctcaccagaggttagaaatttggacccgcgccagatccagatccggactgcttactctaacctagagcagagatccccacggcgcctaataacaattcccacgggcggcgacacggagtcacagcaatcagcacgatccttatcagaaagaaaaaaacaaacaaacaaaccgagggcggcatccgcagtcgagagcagcgcgcgcaggcaagcaggcggcggtcggccggccgctgtatcgctccgccggctccgattcacttggtgcaaggcgggatccgtcccgtcggccgggcggcgggtcccgatctgcaccaagcgagcccgaggcggcgcggcttcgcttcttctccctccttccctccgcgcgaacc

SEQ ID NO: 310 - DNA, 1460 bp, Zea mays
cgaaggcgaagcaaagctaccaacgcatacaagagtgagagcagggagcacgagcgctctgagtgagtggaagacgagaggagttggagttccccagggctagggtttcattcgccacccgcgcctcccttcccttgcccagcatccgtccgccatggtgaggaagaaaagaactggccctggagagagttctggggagtcttctggagcgcctggtcatggctcctcacagcgtcctcaggcaacacaacagggtacccgtggtggagggcaacaccagggccgtggtggatatctgggccctggagtgccgccttcacagcacccaggtggtggcccacctgagtatcatcaaccgcttgactaccagggacgtggtggatatcagggccgtggtggaccaccttcacagcatcctggtggtgggacaccccctgggtctcaactgcgtggctaccaggggcacggtggataccagggccgtggcgggccaccttcacagtatcctggtggtgggacaccccctgggtctcaaccacgtgactaccacggacgtggtggtccacgtcccagagggggaatgccacagtcataccgtggcgggcatgtgggaggtagtgttataccaagtgttccttcaggtccatctaggccagttcccgagctgcaccaagccccagatgtccaacatcaagcccctgtggtggcaacaccatcttcgccaggagctggctcgtcctcgcagcctgggaaggctgaggtgagcgctggacaagtccagcaacagttccagcaacttgcgattcgtaaccaaagcttagccagccaagctggtcagatggcaccagcgtcaagcaaatctgttaggttcccattgcgccctggcaagggtacgcatgggtccaggtgcattgtgaaggcaaatcatttctttgctgagctgcctaataaagaccttcaccaatacgatgtatcaataacacccgaggttacttcacgcggcgtcaatcgtgctgtcatggcagagctagtaaaactttacagacactcccatttggatgggcgtctgcctgcatacgatggaaggaagagtctttatacagctggagcgttgccatttgcttcgaagacattcgaaattactctgcaagatgaggaagacagtcttggtggaggccaaaggcgccagagggtatttcgggtgaccatcaaatttgctgctcgcgctgatctccaccatttggctatgtttcttgctgggaggcagccagatgcccctcaagaggctcttcaagtacttgacatcgtgctacgtgaaatgcctactgccaagtattgtcctgttggtagatcattttattctcccaagttagggagacctcagcaacttggtgaaggtttggaaacttggcgtggtttctaccaaagcataaggcccacacagatggggtcttctctga

SEQ ID NO: 311 - DNA, 826 bp, Zea mays
gtgcagaaaaggcgtccgaacaacacaggttactggagcacgagcgcgctgagtggagcaagagagttggagcttggagcccctccagtgctaagctagggttccatccccaccagcgccgcccgctcccttcctccgtccgcatccggctgccatggtgaggaagaaaaggactggccctggagagagttctggggagacttctggagcgcctggtcagggctcctcacagcgtcctcaggcaacacaacagggtgcccgaggtggaggacaacaccaggtgcgtggtggatatccgggccatggagtgccgccttcagagcacccaggtggtgggccgcctgagtatcaaccacgtggctatcagggacgtggcgttccacctttacttcctggtggtgggccgcctgagcctcaaccgcgtggctaccagggacgcggtggataccagggccgtggcgggccaccttcacagcatcctggtggtgggccatcacctgggtctcagcctcgtggctaccagggacgtggtggtctgcgtcccagagggggagtgccgcagccataccgtggcgggcatgtgggaggtagtgttggaccaattgttccttcaggtccgtctagaccagttcccgagctgcaccaagccccagatgtccaacatcaagcccctgtggtggcagcaccatcaccaccgggagctggctcgccctcgcagcctgggatggccgaggtgaccactggacaagtccagcaactttgtgaattctgaccaaagttcaccagccaaggttatccgggaaccccaccatcaagcaaagttgta

SEQ ID NO: 312 - DNA, 793 bp, Zea mays
cgtccaccgcccacccgctgcgccggcgcccggctgtgcacgcacggacggacagacggacctccccccaagcggtgccggattcagtgcggtgggacaggggctgggacggagtgggcgacagatcgagcgctagcgatgccgcacccgacggacccggaggcggggtccgagcagaaggcggaggcgccggcggtgcctttggcggctgcggcgccggctccggtcaagaagaagcggaacctccccgggacgccagatccggacgccgaggtgatcgcgctctcgccggggacgctgctggccacgaaccgcttcgtgtgcgaggtgtgcggcaagggcttccagcgggaccagaacctgcagctgcaccgccgtggccacaacctgccctggcgcctgcggcagcgcggcccgggcgcgccgccgccgcgccgccgggtgtacgtgtgccccgagcccgcctgcgtgcaccactcccccgcgcgggcgctcggggacctcaccgggatcaagaagcacttctgccgcaagcacggggagaagcgctgggcgtgcccgcgctgcgccaagcgatacgccgtccaggccgacctcaaggcgcacgccaagacctgcggcacccgcgagtaccgctgcgactgcggcacgctcttcaccagacgggacagcttcgtgacgcatcgcgccttctgcggcgccctcggggaggagaccggcagggtgctggcgccaccagcgccgccatcgcctcggccgcctgatttggaggctgacgaaaatgttgctgatt

SEQ ID NO: 313 - DNA, 3129 bp, Zea mays
atagctatgttcccactactagtgacacactagacgttggtctgtgctgtacggagaacgaaggtataaacaaatgcgttgcaaaagtgcagttcgacgacgatagatgtatatgtatactccacaaaagcccgagctgtcttttgtttttggagaaaaaataaataacgtgtggttcaggaacaaaagctagcggggttgctactaattgctactgttgttgataaacacgtcctgatcagacgccacttgcttggatctgtattattattattattattattattattattattattattattattattattattattattatttcctttgctttctttttttgaactgattttttgtgtgttgcaataataatgttaaaagacaaaagtaacggcagggagttgcagatagacctaatatcaaaggctgtcagggcccttttggaacgcagggattttcacttcacaggtgcttttttttatgaaaatgaaccggttcttatgatttctttttttctatgtttcatcatacgagtggaactcgaacatccatcccaaatattagaagacaaaagtaacagtaggagagctgagaagcctgagatagacccaatatcaattaattaaagacttttatagcaaatccaaaaggatgcaaaaacacccccgtcaaaaaaataattattagggacaggttacatttttttggaggcaaatatggtgcatacttcaacagttttattcaaaacaaaggctaaaagaccgtaaaccgagcctatatttttttaaaaaaaaactagatccatctgccccattccgcaaacgattggggagacactacgtcgctcaaatatgtgtgggggggggggggggggagaacataggttgaaagcgggttaccgtatttttccaacaatgatgtgatccgtcgggcatatttggtgacaaggagatcccagaaggattggaggggattgagggggaaatgaactaatttccccctccattatcttgggagcccgggtcaccaaatcaactctaaatctgtctttcgggttgttttaagtgtttttggagttactcttatacgaatatgagtcatttttaaaaaaaaaagataaatcaaaatatacattagtctgtacatagagtgactgctctgaaaaaaataaaaaaactgtagagacaccttagccccaataattgtagcacaggcaacaggtgcacagcacaacatagccccttgcatgcatggctgcagtgtgacacatggcggtggggccctgcccactgttcctccttcagggacggaaaggttggttgcggccccaccatggcgccaagtaatatcgccgctgctctctctctcttttcatgcacacgctcctctctccctccctcccaccattgctacagtcgcagctgtctgtgtctgcaaagtactgactgctcccactccactccacccccagttccgggccactcgggcatcgtttctgttgctgcaaatctttgttggctgctggctgctgctgccttgctatctatctatacaccgcccgcaccttccattcctcctcctccgaagcagcaggcagcagctgcatcgcacctcacacctctcgtgtccatcgatccagccgccgccgcagctgcagctctcacttcactgttgctgtgccacctcctcgtcgcctgtagtgtctgtcgacagagaaacgcccgcggaatgagagggaaggagcggaagctgcagcgggcgcgcgcgtgcaagggctaggattaggagtagcggttgcaacgtcggcgcgcacggcgtacgtcgggcatggattgggatctcaaggcggcgggcgcgtgggacctcgcggagctggagcaggaccacgcggccgcggcgccgtcgtcggggggccacgccgccaatgctgccgcggcgggcacggggacggaaagccgcccgccggcgcccggggcagcaggggcacccgccgagtgctccgtggacctgaagctgggcgggatgggcgagtgcgagcccggcgcggcccgcagggagagggaggccgcggcgggggcggcgaagcggccgcgccccgccgggcccggcgggcagcagcagcagcagtgcccgtcgtgcgcggtggacgggtgcagggcggacctgggcaagtgccgcgactaccaccggcggcacaaggtgtgcgaggcgcactccaagacccccgtcgtcgtcgtcgccggccgcgagatgcgcttctgccagcagtgcagcaggttccatctacttgcagagttcgacgccgacaagcgcagctgcagaaagcgtctggacgggcacaatcgccgccgcaggaagccacagccagacaccatggcttctgctagctttatcgcaagccagcaaggcacgcgattctcaccatttgcgcatccaagactggaggcgagctggccgccgggggtgatgaaaaacgaggagagtccatatcacatcactcaccaaatccctctgggatccagcagcagcggcaacaggcagcagcatttcgtggctctgggagccgccacgcctgcctacgccaaggaaggccggcgcttccctttcctgcaggagggcgagataagcttcgccaccggcgtggtgctggagccgcccgcgtcggctccagcgtgccagccgctcctcaggacgggagcaccatccgagagcagcggcgcaggcggcagtaagatgttctccgatcaggggctggctcgcgtgctcgactcggactgtgctctctctcttctgtcagcgccggccaactcctccggcatcgacgtcagcaggatggtccgcccgactgaacacgtccccatggcccagcagcccgtggttccgggcctgcagttcggcagcgcgtcgtggttcccgcgcccccaggcttccacgggcggctccttcgtcccctcctgccccgccgcggtggagggcgagcagcagctgaacgccgtgctgggccccaacgacagcgaggtgagcatgaactacggcgggatgttccacgtcggcggcggcagcggcggcggcgagggctcctcggacggcggcacctcgtcgtcgatgcccttctcgtggcagtag

SEQ ID NO: 314 - DNA, 1280 bp, Zea mays
ctcccggcctcctcctgcgctcgctgctgctgctgcacactgctctcaggcaggcctagcgttcgtttccttcactttctctgacgccctgatgcgaattaacatctgctgctccccaatcgtctgctcaagattcagcccgctgccacggacacgtgagctcctgcgcttgcttttccgagcggtttcttgctttcacgccctttggcggcgacgggacgggatgcccccccccccccccccccggtactctgccattggctcctcctctagtcggcgctgcttgcttcccggcgacagttcgccaccgccgcagatgaagcgccgccacggtttggcgtgccgcgttgagcgagacaggggtgtactcccagctttggctaccatcaatcatttgatgtttaggtgccgcgttgtgagctgtactgctacagtatctctgcagaatgtattctgtagtagtatgaaaaggttccatctacttgcggagttcgacgccgacaagcgcagctgcagaaagcgtctggacgggcacaatcgccgccgcaggaagccacagccagacaccatggcttctgctagctttatcgcaagccagcaaggcacgcgattctcaccatttgcgcatccaagactggaggcgagctggccgccgggggtgatgaaaaccgaggagagtccatatcacatcactcaccaaatccctctaggctccagcagcagcagcagcaggcagcagcatttcgtggctctgggagccgccacgcctgcctacgccaaggaaggccggcgcttccctttcctgcaggagggcgagataagcttcgccaccggcgtggtgctggagccgccggcgtgccagccgctcctcaggacgggagcaccatccgagagcagcggcgccggcggcagtaagatgttctccgatcaggggctggctcgcgtgctcgactcggactgtgctctctctcttctgtcagcgccggccaactcctccggcatcgacgtcagcaggatggtccgcccgactgaacacgtccccatggcccagcagcccgtggtcccgggcctgcagttcggcagcgcgtcgtggttcccgcgcccccaggcttccacgggcggctccttcgtcccctcctgccccgccgcggtggagggcgagcagcagctgaacgccgtgctgggccccaacgacagcgaggtgagcatgaactacggcgggatgttccacgtcggcggcggcagcggcggcggcgagggctcctcggacggcggcacct

SEQ ID NO: 315 - DNA, 3922 bp, Zea mays
cacgtcactcaagggtcattttcctatttcctgttccccagctgagctatagctcccacagggacagtcccacccaaaacgtaccaatcgtgtgccatcgcgtctttttctcttccattttttttccttacaaaaatcgcttatattatattattggcacgaaaactactcagatgaactcctcagcagctgtagcctctctctctctctctctctctctctctctcacttttttctttaaaattatctgtacgtacgtagatataaatatagctatgttaccactactagtgacacactagacgtgttggtctgtgctgtacggagaacgaaggtataaacaaatgcgttgcaaaagcgcagttcgacgacgatagatgtatatgtatactccacaaaagcccgagctgtcttttgtttttggagaaaaaaataaataacgtgtggttcaggaacaaaagctagcggggttgctactaattgctactgttgttgataaacacgtcctgatcagacgccacttgcttggatctgttttaataataataataataataataataataataataataataatattattattattattattatttcctttgctttctttttttgaactgattcttttgtatgttgcaataataatgttaaaagacaaaagtaacggcagggagttgcagatagacctaatatcaaaggctgtcagggcccttttggaacgcagggattttcacttcacaggtgcttttttttatgaaaatgaaccggttcttatgatttctttttttctatgtttcatcatacgagtggaactcgaacatccatcccaaatattagaagacaaaagtaacagtaggagagctgagaagcctgagatagacccaatatcaattaattaaagacttttatagcaaatccaaaaggatgcaaaaacacccccgtcaaaaaaataattattagggacaggttacatttttttggaggcaaatatggtgcatacttcaacagttttattcaaaacaaaggctaaaagaccgtaaaccgagcctatattttttttaaaaaaactagatccatctgccccattccgcaaacgattggggagacactacgtcgctcaaatatgtgggggggggggggggggggggataggttgaaagcgggttaccgtatttttccaacaatgatggatccgtcgggctgatttggtgacaaggggatcccggaaggattgaagagaattgaggggaaaatgaactaatttccctctccattatctcgggatccagggtcaccaaatcaactctaaatctgtttttcgggttgttttaagtgcttttggagttactcttatacgaatttgagtcatttttttttaaaaaaaagataaatcaaaatatacattagtctgtacatagagtgactgctctgaaaaaaataaaaaaactgtagagacaccttagccccaataattgtagcacaggcaacaggtgcacagcacaacatagccccattgcatgcatggctgcagtgtgacacatggcggtggggccctgcccactgttcctccttcagggacggaaaggttggttgcggccccaccatggcgccaagtaatatcgccgctgctctctctctctcttttcatgcacacgctcctctctccctccctcccaccattgctacagtcgcagctgtctgtgtctgcaaagtactgactgctcccactccactccacccccagttccgggccactcgggcatcgtttctgttgctgcaaatctttgttggctgctgctgccttgctatctatctatacaccgcccgcaccttccattcctcctcctccgaagcagcaggcagcagctgcatcgcacctcacacctctcgtgtccatcgatccagccgccgccgcagctgcagctctcacttcactgttgctgtgccacctcctcgtcgcctgtagtgtctgtcgatagataaacgcccgcggaatgagagggaaggagcggaagctgcagcgggcgcgcgcgtgcaagggctaggactagcggttgcaacgtcggcgcgcgcggcgtacgtcgggcatggattgggatctcaacgcggcgggcgcgtgggacctcgcggagctggagcaggaccacgcggccgcggcgccgtcgtcggggggccacgccgccaatgctgccgcggcgggcacggggacggagagccgcccgccggcgcccggggcagcaggggcacccgccgagtgctccgtggacctgaagctgggcgggatgggcgagtgcgagcccggcgcggcccgcagggagagggaggccgcggcgggggcggcgaagcggccgcgccccgccgggcccggcgggcagcagcagcagcagtgcccgtcgtgcgcggtggacgggtgcagggcggacctgggcaagtgccgcgactaccaccggcggcacaaggtgtgcgaggcgcactccaagacccccgtcgtcgtcgtcgccggccgcgagatgcgcttctgccagcagtgcagcaggttccatctacttgcggagttcgacgccgacaagcgcagctgcagaaagcgtctggacgggcacaatcgccgccgcaggaagccacagccagacaccatggcttctgctagctttatcgcaagccagcaaggcacgcgattctcaccatttgcgcatccaagactggaggcgagctggccgccgggggtgatgaaaaccgaggagagtccatatcacatcactcaccaaatccctctgggctccagcagcagcagcagcaggcagcagcatttcgtggctctgggagccgccacgcctgcctacgccaaggaaggccggcgcttccctttcctgcaggagggcgagataagcttcgccaccggcgtggtgctggagccgccggcggcggctccagcgtgccagccgctcctcaggacgggagcaccatccgagagcagcggcgccggcggcagtaagatgttctccgatcaggggctggctcgcgtgctcgactcggactgtgctctctctcttctgtcagcgccggccaactcctccggcatcgacgtcagcaggatggtccgcccgactgaacacgtccccatggcccagcagcccgtggtcccgggcctgcagttcggcagcgcgtcgtggttcccgcgcccccaggcttccacgggcggctccttcgtcccctcctgccccgccgcggtggagggcgagcagcagctgaacgccgtgctgggccccaacgacagcgaggtgagcatgaactacggcgggatgttccacgtcggcggcggcagcggcggcggcgagggctcctcggacggcggcacctcgtcgtcgatgcccttctcgtggcagtagtcgtcgtcacttgtcagcagccgctgcgttctctcatctttcgcgcttcagacgatctggtagggagatactggctttagtgatcactgatcagcattgatttctgttctttttcctgcattcgctttgttgaatcggctctgctcgccagcattcgtgtggacattttttgaacataattctgtgttcgtttccctcacattatctttgctacggtgacacctgccggctgctgaccgtagcatgttccttctcttgtgacttgttctcgagacgtccatttgatgcagggcgcatccagaatttttcagttgcagtgcagacgcaatccgatgcgtttgaagatgacgggcatgtttggttcacggctaactgtgtcatacttcgactaaagttagtcgtccaaattgaagaactaactcaggcagaaaagttagataaaatgtggtaagttaggtagtaaaccaaacagacccgacaactgaggacttgttcggtttgaaggggtttaaggggattagaggggattc

SEQ ID NO: 316 - DNA, 1240 bp, Zea mays; identical to SEQ ID NO: 244

SEQ ID NO: 317 - DNA, 884 bp, Zea mays; identical to SEQ ID NO: 238

SEQ ID NO: 318 - DNA, 1342 bp, Zea mays
cacacacgcgagcacgcgcccgcactgttcgctcgctccccatctccacacccgccgctctccacagtgctgctatcgagacgtctttctccgattgcggaggcgtttctttccttcttcgccggcggcggcatggactgggcagcggcgtccgggtctccgtcgtggggcgcggcggcgacggaccccggtccgaccatgctgtccttcgcaggcccgtcctcctccgccgccgacgccgaggtgcggctccaggatttcgccgcgggtcttgcccagagctcgcggccgactggggcggcgccgggagccgggaggaggtcccgcgcggccgtgggaggtgccggcgcggaggcgtgctccgtcgacggctgccgctctgatctcagccggtgccgcgagtaccaccggcggcataaggtctgtgaggcacactccaaggcgccggtggtggtcgtcggcggacaggagcggcgcttctgccagcaatgcagccggtttcacatgctgtccgagtttgacgaggaaaaaagaagttgccggaagcgtctggatggccataataggcgtcgaagaaagccacagcatgatctgacaaatctagggggtttctttccataccaccaagtgaatcagtttgagttctacccacaaacaattccaacagttggccagaattcggacgccgtgcacttggtgggccgtcagcagcctttctccatatcgttctcaagaacaccagacgagttccctttcccacagggtggcggtagcagtgtgctgcaccacctccatgcagcccgccctggccatcacgctgaaggcagcagccacactggaagcagcacacgcgacaacgctctttccggcacactgggccccgagtgtgctctctctcttctgtcatcgtcgctgcgtcgcccctcaactgctggcgtccccgccgttggccaaccccaggttactgcctcttcgaccactgccgtgtcgcaggctgcaacggcagctgtggccactgctgcattcgcggccagtgctggcccccatgtgtttgttcctgatgctatgtttgaggatccatcacaggcactgccattctcttggcagtaggattgttttgttgtcctgtttttatgtgctcctgttgtgttctcgatcgatactctagtgtctgatggctgggaattcggggtacctgtgcacttgcagactcaggttgtggtccgtcagagatgtatacaagtgacacgacgactagtgctggcatctgaaaggaagtggtagctgctgtgcagagtgtttagccgttaaattcaaatgcgcccgttcaatttttttcttc

SEQ ID NO: 319 - DNA, 769 bp, Zea mays
ccagcccctcctcaagacgaccgccgccgtggccccgccgccgcccgagagcagcaagatgctcgcccccgtgctggactgggattgtgttctctttcttctgtcatcccccgccaactcttccagcgtcgacgtgagccggatggtccagcccgcggagcgcatccccatggcgcagcccctcgtccccggcctccagcaccaccagttcggcggctccccggtgccggactggttcgccggctccggcgccgtccctgccgcgggcaccggcgggttcgcctgcccccacagcgtggagagcgagcagttcaacacagtcctagtgccgagctccgacggcggccacgagatgaactaccacggcatattccacgtcggcggcgagggctcctccgacgggacgtccccttcgctcccgttctcgtggcagtagcttaccgttgaagcgggcagtgttatgatcggtcagctgtatagcggtggtcatcacaccagttccctcttctttccgtgtttatttattctctgctccctcacgcactcccccgtgtcacttgctagtttcttagttttgcatgcctgatgcatgtagcctgaaaaaactctatcaaattagtgccagatttcctagttcccgtttgtttcattttattttgagaattggaatcttactaatgatttcctagttcccgtttgtttcattttattttgagaattggaatcttattaatgtaataggctattttttagaatgtgacattccacc

SEQ ID NO: 320 - DNA, 1435 bp, Zea mays
cgggacacacgtacgttgaacaaacacccaaggcctgacgagacgagatccggacctccgtcctcccaactagggcgcgcgcgcgacctcggcaccggcggcctcgatccatcgttctctcggatccccgccagtgcatgccctggaacggacggacggaatggcagcgtcgccggaccacctcttcggcctgcgcaacagcttctacgtcggcgcataccacgccgtcatcaccagcagccagtccctccccgcgcacgcgctctcccccgacgacctcgtcgagcgcgacgccctcatgtaccgctcctacatcgccatcggctcctaccagctggtgatcggcgagatcgggcccagcgcggccacgccgctccaggccgtcaagctgctcgccgtgtacctctccggcgacggcgggaacagggaatcggtggtctcgaggcttcgtgagctcctgtcagacgcggcggtcgggagcaatccgattctccgggtgatggccggcaccgtcttcatgcacgaacgcgattacgccgaggctctcaagcacaccaactccggtggcagcatggagctgcttgcgctgaatgttcagatataccttcaaatgaacaggacggaccacgcagagaagcagctcagggtgatgcagcagctggacgaagaccacacgctgacgcagctcgccaacgcatgggtcgaccttgtgctgggtggttccaagatccaagaagcgcgcctcatcttccaggacctgtccgagaagtacccgacgacctgcacgattcttaacgggaaagccctgtgctcgatgcacatgggcaacttcgaggacgcggaggggttgctgctcgagtcactgaacaaggacgccaaggatactgagactctcgccaacctcacggtgtgcagcctgaacctggggaaacccgcaacgcgctacctcaaccagctgaagctcgcacacccggaccacgcgctggtgaagcgaatgtcctccgctgcagagagcttcgacagagcctgccaagcaatggcgtgaacctcgtttgcgaaaattacatttgttttccctaggatgagtcggaataacatcgtgatctactttgaagcaaagcagctagtgcatggctttttcatgggcagcttggactcccccgtcggcatgcttttccactggtctcggatagtacattcggcctcgctggtgcgctggaaaggcccaggtgtttcctttaccttttgggctatgctctctctctttctgaccccttgttgcgatgggagtgactgaggggaagcaatccttgaaatcctaaacaggagatagcatgaaacagtatttggttcaggtactgcaatgctgggggtcatatctcatatgcctgttccgatctgcatataataatagggtgtttggttcaatgagact

SEQ ID NO: 321 - DNA, 856 bp, Zea mays
cccacctcctctgcctgcctctttcacacggagcaagcgcgcagagaaagagaggccgttccgttcccttttgtcgctgggcagcatggccatcccgctgccgtgcaaggcgctgccgcggcatgacgggacgaagggcagcgggcaggcgtacgacggcgacgaccagccgtcggtggctgcggagctgcgcgcgctgtggggcatggcggcgcctgtcactgctctcaactgcgtggtgtacctgcgcgcgatggtgtccgtgctgtgcctggggcggctgggcccgctggacctggcgggcggcgcgctggccatcgggctgaccaacatcacgggccacagcgtgctgttcgggctggcgtcggggctggagccgctgtgcgcgcaggcgttcgggtcccgcaaccacgagctgctgacgctgtccctccagcgcgccgtgctgctgcttctcctggcggcgctgcccatcgcgctgctgtggctgaacgtgggccccatcctggtggcgctggggcaggaccccaccatctcggcgcacgccgcgtcgtacgccgcgttcgcgctcccggaccttgccgcgggcgccgtgctccagccgctgcgcgtgtacctccggtcgcagggcatcacgcgccccatggcggcctgctccgccgccgccgtggcgctgcacgtcccgctcaacgtcggcctcgtcttcggcttgggcctcggcgtgcgcggcgtcgcggcggcgcaggccctcaccaacgccaacatgctgctcttcctgctcgcctacgtgcgctgggcgcgcgcctgcgagcacacctggaagggctgggcgcgccccgccgacgtcgccgcccgt

SEQ ID NO: 322 - DNA, 2298 bp, Zea mays
cagcaacgcacggagcgtacgtacattgcagtagctagctatagctggccggccatcccctctcgctcgctgctaaacacgttccagcttgtttgctcagagaaacagcgcgcgcgcacacacacacacatcatcatcatcgattcatcgtacacaggatcagagagcttaattagttctagctctgctgcatgccccttcgacaacgtccgacgatgggcggcggcggcggcggtgtagctaagatgccggcaggccagctctggttattactgctaggcgtgttgttgttagcatttggagtcccagcccaggcctccaggaatactcactacgacttcgttataactgagacgaaggtcacccgactatgccatgagaagaccatcctggccgtgaacgggcagttcccggggccgaccatctacgcgcgcaaggacgacgtggtcatcgtcaacgtgtacaaccagggctacaagaacatcaccctccactggcacggcgtggaccagccgcggaacccgtggtccgatggcccggagtacatcacgcagtgccccatccagcccggcgccaacttcacctacaagatcatcttcaccgaggaggaaggcacgctgtggtggcacgcgcacagcgaattcgaccgcgccaccgtgcacggcgccatcgtcatccaccccaagcgcggcaccgtctacccctaccccaagccgcacaaggagatgcccatcatcctcggcgagtggtggaacgcggacgtggagcagatcctcctcgagtcccagcggaccggcggcgacgtcaacatttcggacgccaacaccatcaacggccagcccggcgacttcgccccgtgctctaaggaggacaccttcaagatgtccgtggagcacggcaagacgtacctgctccgggtcatcaacgcggggctcaccaacgagatgttcttcgccgtcgccgggcaccgcctcacggtggtcggcaccgacggccgctacctcaggccgttcaccgtcgactacatcctcatctcccccggacagaccatgaacatgctcctcgaggccaactgcgccaccgacggctcagccaacagccgctactacatggctgcgaggccgttcttcaccaacacggcagtcaatgtcgacgacaaaaacaccacggccattgtggagtacacggacgcgccaccctccgcgtccgcggggccaccggactcccccgacctgccggccatggacgacatcgccgcggcgacggcgtacacggcgcagctccggtccctggtcaccaaggagcatccgatcgacgtgccgatggaggtggacgagcacatgctcgtgacgatctccgtcaacacgatcccctgcgagcccaacaagacgtgcgccggccccggaaacaaccgcctcgccgcgagcctgaacaacgtcagcttcatgaacccgaccatcgacatcctcgacgcctactacgactccatcagcggcgtttacgagccggacttccccaacaagccgcccttcttcttcaacttcaccgctcccaacccgccacaggacctctggttcacgaagcggggcaccaaggtgaaggtggtggagtacggcaccgtcctggaggtggtgttccaggacacggccatcctcggcgccgagagccaccccatgcacctgcacggcttcagcttctacgtggtgggccgaggcttcggtaacttcgacaaggacaaggaccccgccacgtacaacctggtcgacccgccgtaccagaacaccgtctccgtgcccacgggcggttgggctgcaatgcgcttccgagcggcaaatcctggtgtgtggtttatgcattgccactttgatcgtcacacggtgtggggcatggacactgtgttcattgtgaaaaatggcaagggcccggacgctcagatgatgccacgtccccctaacatgcccaagtgctgagaaaacaagggcacgagctacgactgctcgggttgcatgcaaggcgctcgatcaaaccagctaatcttagttgattggttgatttaattatttgtggtacatattttaagtagaacggttcttcaaataaaacggccagttgagatgtaattagtgtcatttgtgttcttttctctttttattcatttgattgtaagagaaaaacaaattcattatatttattatttgtgtcggtctactgctagttcaatctccaagtgtaattaaacaatgtatgtcaaatcatgtatctagtgaaaattcaatataaatgcgtgcttcccaagac

SEQ ID NO: 323 - DNA, 2033 bp, Zea mays
cttgcttcaaagcgcaaacacacaagaagggcggagctgttgtcatcctgacaatgggcgcgcgtcgtggtctccggcgaggccaagccgccgccgccgccttctccgcatgtcccttcctcgccctcgccgtcgtcctcctcgccttgccggagctcgcagccggcgacacccactactacacgttcaacgtgcaaatgaccaacgtgacacggctgtgcgtgactaagagcatcccgacggtgaacggggagttcccggggccgaagctggtcgtgcgggaaggcgaccgcctcgtggtcaaggttcacaaccacatcaactacaatgtctcgttccactggcacggcgtccggcagctgcgcaacgggtgggcggacgggccgtcgtacatcacgcagtgcccgatccagggcgggcagagctacgtgtacgacttcaccgtcacggggcagcgcggcacgctgtggtggcacgcgcacttctcctggctgcgcgtgcacctctacggcccgctcgtcatcctccccaagcgcggcgagggctacccgttcccgcgcccctacaaggaggtgcccatcctcttcggcgaatggttcaacgcggacacggaggccgtcatcaaccaggccctgcaaacaggcgccggcccaaacgtctccgatgcctacaccttcaatgggcttccaggcccgacatataactgctcgtctaaagacacgtacaagctgaaggtgaaagcccgggaaggacgtacatgctcccggcttcatcaactccgccctcaaacgaacgagctcttcttcggcatcgccaaccacacgctcaccgtcgtcgaggcggacgccagctacgtcaagccattcaccgtcagcacgctcgtcatttcaccggggcagaccatgaacgtgctcctcacgacggcccccagccccgcctccccggcctacgccatggcgatcgcgccctacaccaacacgcagggcacgttcgacaacaccaccgccgcggccgtcctcgagtacgccccgacgccgccgcccgtcgccaccaggaacaacaccctgccccccctaccggccctgccgctgtacaacgacaccggcgcggtgtccaacttctcgcgcaacttccgcagcctgaacagcgcgcggtacccggcgcgcgtgccggcggcggtggaccggcacctgctgttcaccgtggggctcggcacggacccgtgcccgtacaccaaccagacgtgccagggccccaacggcaccaagttcgcggcgtccgtcaacaacaactccttcttccgcccccggaccgcgctcctcgaggcgcactaccggcgccgctacgccggcgtgctcctgggcgacttccccacggccccgccgcacccgttcaactacacgggcaccccgcccaacaacacgttcgtgcagcacggcacgcgggtggtgccgctccgcttcaacgcctccgtggagctggtgctgcagggcaccagcatccagggcgccgagagccacccgctgcacctgcacggctacaacttcttcgtggtcggccaagggttcggcaacttcgacccggtgaacgacccgcccgggtacaacctcgccgaccccgtagagcgcaacaccatcagcgtgcccaccgccggctgggtcgccgtccggttcctcgccgacaacccgggcgtgtggctgatgcattgccacttcgacgtgcacttgagctggggcctgtccatggcgtggcttgtcaacgacggcccgctgccgaacgagaagatgttgcccccgccatccgacctcccaaaatgctgatgacgactggtcgtttatcacccgatcgaggggtagatgggcatttaggaaggttctcctgcttcctgcacgtctgcctacttcctttccttacgatgtttggaactatttggtttggactatttaattaccgtgtgccgatttttggcgagtgcttggatttcgcgatcctcgctgaatccccttttgaaacatgttaatctgtatctatgt

SEQ ID NO: 324 - DNA, 1124 bp, Zea mays
cttatgcaatgaaataaaaaaggaaaaaagaaaaaaagaaaaagagaaacaattaaaaaagtcaataaaaaagaaaaagaaaaacaatttaaaaagtccgacgcctgagagattcgaactctcgcggggaaaccccatgtacttagcaggcacacgccttaaccactcggccaaagcgtcagttggtgcagtacagaatatttgacaatataaggtagttaaaaataatctctccgtgtgctgaagcaggttgcctgagcccctgacacggtgacaccacactcccgaaacgccgaaaccccaccccgcaccaatcatggacgccgccgacgcgcgtccatcggcaccgtcggccgctgctgccgcagtcgccggggcctccgtcgcggacgagccccgggacgcgcgggtggtgcgggagctcctgcgctcgatgggtctcggtgagggcgagtacgagccccgcgtcgtgcaccagttcctggacctggcctaccgatacgtcggagacgtgctaggggacgcccaagtctacgccgaccacgccgggaaggctcagatcgacgccgatgacgtccgcctcgccatccaggccaaggtcaatttctccttctcccagccgccgccgcgtgaggtaccaatcctaccctattctcagtttgggcaaatcagttggcttatgtttattttcttctatccccgccaaagcaactttctccctgcgttggttttatacggccgagtccatgaaacctagttattttgctgcccgtatagttgaaacttgattttgaattagttttgtttttgctggattagtttggtcgagaacctgatatttctttaccattgtttttgttaatataatattaataagagttttgctggcacctctctaatcatgaagtagtatctactatttatagtcttagtgaaattatgtctttttaaatttattaattggtccctgctcaattccgttgatagagagatggaaatgtcgatatacaacatagattcagatatatattcagaaagagtttagatactaaaagccacatagatcagagacaataacatcctaatccaaaacataaccattaagagaagattctcgtgccagg

SEQ ID NO: 325 - DNA, 487 bp, Zea mays
attgaaacgaacatctgtaaaagtattgaacagtaaaagatagagcaaattgtacatcaggcttgtcctgaaacgtgatacacacgtatatatatacatactggttcatttatgcatgaatccaattatccagattaaagtttcccggcgcttgggaggcaatagcatgcatatccatgtctgcaatgcaactgcaagtaagagatagaaatgacgagaaattatcagtagaccgccacgggaaggagagtgagtgagagagacagacagacagacagagaggagctcccttcaatccaagcacgagggaaagatgatggcgggctcatctcccgggtcatgcacacccatgcaagtgcagaggtgagcagcggccattgctgcaccagagaggtatccatgaaccggcagctgcaaccgaccacttcccctcctggattggatcgaagggagctcttcgatcgcctttcttaatcatgcatcttct

SEQ ID NO: 326 - DNA, 1413 bp, Zea mays
  misc_feature (1271)..(1271): n is a, c, g, or t
  misc_feature (1302)..(1302): n is a, c, g, or t
  misc_feature (1312)..(1312): n is a, c, g, or t
  misc_feature (1326)..(1326): n is a, c, g, or t
  misc_feature (1342)..(1342): n is a, c, g, or t
  misc_feature (1360)..(1360): n is a, c, g, or t
  misc_feature (1363)..(1363): n is a, c, g, or t
cttcctctctctctctatctctctctcagtctctctcttcctcctcaaaactctctctcccagcactgaaaattctccacatactctgctgctgctaagtggtggcatctcgtttaggcgagatccccctcctcccccgctttccactcctctcctccaccctagtcgactccttccctgcaatccgctggccggctcacagtaccagaggagtccaccggaggagctcagctagactcccaccctggtggctcgatcggcaccggccgctgcctgcgagactccgccagcgcgcgatgtaccgggtgaagagcgagggggagggcgagggcgagggcgactgcgaaatgatgctgcaggaacagatggactcgctggtggccgacgacgtcagcagcggaggagggtcgcctcacaggggcgtcggcacgcccctgaagaaggggccatggacgtccgcggaggacgccatcctggtggactacgttaagaagaacggcgagggcaactggaacgcggtgcagaagaacaccgggctgttccgctgcggcaagagctgccgcctccggtgggcgaaccacctcaggcccaacctcaagaagggggccttcacccccgaggaggagcgcctcatcatccagctccacgccaagatggggaacaagtgggcgaggatggctggtcacttgccagggcgtactgacaatgagatcaagaactactggaacactcgaataaagagatgtcaacgagctagccttcctatttatcctgctagtgtatgcaatcaatctacaaatgaagatcagcaactgtctggtaattttaacggtggcgagaatatatccaatgatcttctatctgggaacagcctttatctgccagattttaccagtgacaatttcattgcgaacccagaggctttatcctatgcaccacagttgtcagctgtttcaataagcaatttgctcgggcaaagctttgcatcaaaaagttgtagcttcatggatcaggttgaccaagcggggatgctgaaacaatctggctgtgtgcttcctgcattgagcgatgccattgacagtgtgctttcctcagctgatcatttttcaaatgactctgagaagctcaggcaggctttaggttttgattatctaaatgaagccaatgctagcagcaaagagtattgcacctttcggggttgcacttactggcagccatgcctttttaaatggcaatttctctgcttctaggccccacaaatggtcctttgnagatggagctcccttcactccaagatactgnatctgatccnaatagctggctcangtatactgtggctccnggcaatgcagcctactgnatnagtagatccttacctgcatctccatcagcgaccccttcagtgaatctgag

SEQ ID NO: 327 - DNA, 1439 bp, Zea mays
cccctcctcactgactcacctgcaaaaaccacttgcaaaccacacaaaccgaaaccgccagctcccctgcctccatttttagcaacttttcccttcaatctcccgtcgcagtcacccttcttgcacccccgcgcagcttccgacacctccgaccttctctggcggcgccccgccgttggacgctcatggagaagagcccgggcgccgcgccgacatcatcgcccgaggaggaggtggcggcggatggccgcgggcacgttgaggacgcgacggggcagaaggagcaggcgacgccggtggtgctcaagaaggggccgtggacggcagcggaggatgccatgctcatggaccacgtccggcaccacggcgaggggaactggaacgcagtgcagagggtgaccggcctgctgcgctgcggcaagagctgccgcctgcgctggaccaaccacctccgccccaacctcaagaagggctccttctcccccgacgaggagctcctcatcgcccagctccacgcgcagctcggcaacaagtgggcgcgcatggccgcgcatctgccggggaggacggacaacgagatcaagaactactggaacacgaggaccaagcgccgccagcgcgccggcctgcctgtgcacccgccgccagaggtgcagctccagctcgccctcgccaggcgctgccgctacgacgacttctcgccgctgccgtccccgcaggagctgtccggtgtccaggcgctggtgggcgccgccgcctcggccgggtacgccagctcccgcccggcgcccctcgacctggctcggcagctcacccagacgacgaaccagcagacggagactgtgcagttcctctcgccgccacccttctcggcgccgtcgtccccgtgggcgaggccgttcgcccggaacgcgcagtacttccagctcgcgcactcgtcgtcgcccgtgtccccgacgacgccggacctgtccctcggctacggcgcgcgcagcgccggcgccgaccagagcaggctcccgccgctctcgccttccccttgccccagagtgggggagctcccttcaaaccaatacgcccaaccgacgccgccggcttcggccgccgcccccccacttggaggtgggggggcagcgctgccggatcatcagaacgcggcgagcctcgagaagatgttgcgcgagctccatgacttcatcaaggtcgaccccccggcgctggtcccgcccagcggcggcgctcccctggagtggcatggtgggggaggggagtagtccatcccgtgtgtgaaccattttttttcgctttttccctttatttttggatccccgcgggagtagggagttcgatttgttgctttgcggggggaagagaacaaatatgctcatgattactgtgtgaactggcagattagcgtgacccttttcttttgtggttcc

SEQ ID NO: 328 - DNA, 1448 bp, Zea mays
gcctcaaaagggcagacagccaaatgccccaccacagcgtagcccctcctcactgactcgcctgcaaaaaccacttgcaaaccacacaaaccgaaaacgccagctcccctgcctccatttttagcaacttttcccttctgtcttcccatcacagtcacccttcttgcccccacgcagccgagcgtgcctacccctcctcgacccttctctggggccgccgttggacgctcatggagaggagtcgtccgggcgccgcgccgacaccatcgccagaggaggaggtggcggcggagggccatgcgcatggtgacgatgtgacggggcaggaggaggaggcgacgccagtggtgctcaagaagggcccgtggacggcctcggaggatgccatgctcatggaccacgtccggcaccacggcgaggggaactggaacgcagtgcagaggatgaccggcctgctgcgctgcggcaagagctgccgcctgcgctggaccaaccacctccgccccaacctcaagaagggctccttctcccccgacgaggagctcctcatagcccagctccacgcgcagctcggcaacaagtgggcgcgcatggccgcgcacctgcccgggaggacggacaacgagatcaagaactactggaacacgaggaccaagcgccgccagcgcgccggcctgcccgtgtacccgccggaggtgcagctccaccttgccctctccaagcgctgccactacgacgactacgacttcccgccgctcgcgtcgtccccgcagctgtcggcgacgacgacgaccgatgtccaggcgctgggcgccgggcccgggtacgccagctcgcgcccggcgccgctcgacctggctcgcagccagctcgccgcgacgacgacccagcagacggcgcagttcctctcgccgccgcccttctcggcgccgtcgtccccgtgggccaagccgttcgcgcggaacgcgcagtacttccagctcgcgcactcgtcgcccgtgtccccgtcgacgccgaccgggccggtgcacccggccatgccggacctgtctctcggcggccacggcgcgcgcgccgccgccgctgccgaccagagcaggctcccaccgctctcgccgtcccccggccccagagtggagctcccttcaaaccaatacggccagccggcgccgccgacctcggccgccgccgtcgccgccggacttgcgctgccggatcatcagaacgcggcgagcctcgaacagatgctgcaggagctgcacgacgtcatcaaggtcgaaccgcaggcgctggtcccggccagcggcggcggcgctgcactggagcggcatgattgcggagtttcagtcccagagagcagaatcagcggcctgcagcgtcggggtgacgacatggacacgctgttcggcctggtgcacccagcgctcggcgcgccggagacggcgccg

SEQ ID NO: 329 - DNA, 774 bp, Zea mays
cccttgccccagagtggtggagctcccttcaaaccaatacgcccaaccgacgccgccggcctcggccgccgccaccgcacttggaggtggtggggcagcgctgccggatcatcagaacgcggcgagcctcgagaagatgttgcgcgagctgcatgacgtcatcaaggtcgacccgccggcgctggtcccggccagcggcggcgctgccctggagtggcatggtggcggagaatttgtgagcggcctgcaggccctgcagcagcatcgggttgacgacatggatattttgtttggcctgctgcacccgccgctccgccgcgcgccggagacggtgggggcggcagctgcaggctccacccactccggttcgacctcgcagcacagcagggaggaccagaagcccaccgacgtcgtcggcctcggcctggacctggacctccaggtcgccggcagcaccgtttttttggaccaggaggactggggcctcgaccccgtctgtcagtggagcagggtgtccaggatttgctgatcgcgtgcacggactgcagggatcggggtagggatgccgaattgtcggtcaagacatcgtgcatgcatccggtgattttgagaactggaagagagagagaatgcctttttttttgaacgtttaaattttttgctgctgtcagatgccaagcagcatgggcaaacggatttgtttcccgttcaatgttcatgacgactatggttggttagttaccgagtcggctgcgcaacccaacggaatttgcg

SEQ ID NO: 330 - DNA, 1272 bp, Zea mays
ctgtcttcccatcacagtcacccttcttgcccccacgcagccgagcgtgcctacccctcctcgacccttctctggggccgccgttggacgctcatggagaggagtcgtccgggcgccgcgccgacaccatcgccagaggaggaggtggcggcggagggccatgcgcatggtgacgatgtgacggggcaggaggaggaggcgacgccagtggtgctcaagaagggcccgtggacggcctcggaggatgccatgctcatggaccacgtccggcaccacggcgaggggaactggaacgcagtgcagaggatgaccggcctgctgcgctgcggcaagagctgccgcctgcgctggaccaaccacctccgccccaacctcaagaagggctccttctcccccgacgaggagctcctcatagcccagctccacgcgcagctcggcaacaagtgggcgcgcatggccgcgcacctgcccgggaggacggacaacgagatcaagaactactggaacacgaggaccaagcgccgccagcgcgccggcctgcccgtgtacccgccggaggtgcagctccaccttgccctctccaagcgctgccactacgacgactacgacttcccgccgctcgcgtcgtccccgcagctgtcggcgacgacgacgaccgatgtccaggcgccgctcgacctggctcgcagccagctcgccgcgacgacgacccagcagacggcgcagttcctctcgccgccgcccttctcggcgccgtcgtccccgtgggccaagccgttcgcgcggaacgcgcagtacttccagctcgcgcactcgtcgcccgtgtccccgtcgacgccgaccgggccggtgcacccggccatgccggacctgtctctcggcggccacggcgcgcgcgccgccgccgctgccgaccagagcaggctcccaccgctctcgccgtcccccggccccagagtggagctcccttcaaaccaatacggccagccggcgccgccgacctcggccgccgccgtcgccgccggacttgcgctgccggatcatcagaacgcggcgagcctcgaacagatgctgcaggagctgcacgacgtcatcaaggtcgaaccgcaggcgctggtcccggccagcggcggcggcgctgcactggagcggcatgattgcggagtttcagtcccagagagcagaatcagcggcctgcagcgtcggggtgacgacatggacacgctgttcggcctggtgcacccagcgctcggcgcgccggagacggcgccg

SEQ ID NO: 331 - DNA, 849 bp, Zea mays
  misc_feature (7)..(7): n is a, c, g, or t
  misc_feature (732)..(733): n is a, c, g, or t
  misc_feature (771)..(771): n is a, c, g, or t
  misc_feature (787)..(787): n is a, c, g, or t
cgtccgnattcccggccgacccagcgtccgcgccgttggtcgctcatggagaagagcccgggcgccgcgccgacatcatcgcccgaggaggaggtggcggcggatggccacgggcatgttgaggacgcgacggggcagaaggagcaggcgacgccggttgtgctcaagaaggggccgtggacggcagcggaggatgccatgctcatggacctgtccctcggctacggcgtacgcagcgccggcgtcggcgccggcgccgaccagagcaggctcccgccgctctcgccgtccccttgctccagagtggtggagctcccttcaaaccaatacgcccaaccgacgccaccggcctcggccgccgccaccgcacatggaggtggtggcgcagcgctgctggatcatcagaacgcggcgagcctcgagaagatgctgcgggagctgcatgacgtcatcaaggtcgatccgccggcgctggtcccggccagcggcggcggcgctgccctggagtggcatggtggcggagaatttatgagcggcctgcaggccctgcagcagcatcgggttgacgacatggatactctgttcggcctgctgcacccgccgctccgccgcgcgccagagacggtgccgccggcagctgctgcctccacccactccgtctcgacctcgcagcacagcagcgacgaccagaagcccaccgacgtcgtcggcctcggcctcggcctggacctnncagtcgccggcagcggcagcaccggctcgtcggaccangaagactggggcctcnacgccgtctgccagtggagcagcgtgtccaggatctgctgatcgcgtgcacggactgcaggg

SEQ ID NO: 332 - DNA, 1444 bp, Zea mays
cacgagacatatcgatggcgttcatcagcagtgcggcgatgaaggcagccgtggccgctctgctggtgttcgccgcggtgtcgcctgccgcgcgcgcggtggcggcggaggcggaggcgaaggcgaaggctgtgggaggcgcgccgtcggtgcccgctggctcgctggacatcgcgcagctgggcgccaagggcgacggcaagtcggacagcaccccgatggtgctcaaggcgtggaagcacgcgtgcgaggcgacggggcagcagaagatcgtcatccccaagggcaactacctgacgggcgcgctggacctggtgggcccctgcaagtcctccatcatcatccgcctcgacggcaacctgctcggcaccggcgacctcaacgcgtacaagaggaactggatcgagatccagaacgtcgacaacctgtccatcaacggccacggcaccatcgacgggcagggagccctggtgtggaacaagaacgagtgccagcgttcctacaactgcaaaatcctccccaacagcctggtgctggacttcgtgacgaacgcccagatccgcggcatcacgctgctgaacagcaagttcttccacatgaacatcttcgggagcaagaacgtggtgatcgacaaggtgacgatcaaggcccccggcaacagccccaacacggacggcatccacatcggcgactcgagcaacgtgaccatcagcggcaccaccatcgccgtcggcgacgactgcgtctccatcggccccgggagcaagaccatccgcgtgaagggcgtcaagtgcggcccgggccacggcatcagcgtcggcagcctggggcggtacaaggacgagagggacgtggaggacgtgaaggtgacggggtgcacgctcgccggcaccaccaacggcctgcgcatcaagtcgtacgaggactccaagtcgtcgctcaaggccaccaagttcctgtaccaggacgtcaccatggacaacgtctcctaccccatcatcatagaccagaagtactgccccaacaacatctgcgtcaagtccggcgcctccaaggtggccgtcaacgacgtcgtcttcaagaacatccacggcacctccaacacgccggaggccatcacgctcaactgcgccaacaacctgccctgccagggcgtgcagctcatcaacgtcgacatcaagtacaacaggtccgacaacaagaccatgtccgtctgcaagaacgccatcggcaagtccattggcatggcgaaggagctcgcctgcgtctgaacctacttgtatccatcactcactcttcgtcaccgctctctttctcactctcgccagtctttttttaggcatctgacaatctgcgaactttcttattcatttccattcaaaatatatacatgatctaaatttcatgccacagaggacattgcaatgcacaagtttaagaccaa

SEQ ID NO: 333 - DNA, 1856 bp, Zea mays
attttgacagcagcagcaacctcatgtctagcttccgccctgctccctcagccttgagcatgggccttgagagcaaccgcagtctggaggatctcgtttgcactggtcagggctcgagcaacgttggcctcctctcaagtctttctccaggcggtcaactcggccggagcaccgtaatggaaagcttcagctcaggtctgccaacaagcttcaaccaaggaatcatcaacgctggtggaagcataaccaacatcaccagtagcaacataaataacgtccgctctaacttccccctcatggcctcaccttcgaacttttccgatgcgtaccgcgctcgatcagtgagcgaagacaagtctgggaaagttgttggctctggcggcccacggaatgaacttgtgccatatcacagaaacaagggggcggaaactcggagccatggtcagggtcagcaaactctattcttgaagcgcgcagcttctcgccgttgtgcggggtctagtgggactgtctctccagtgagcaagtcacccccacgcgtggtcactagtgcctccaacgattcttctgtggacacgccggataaagacagccctcatccgcgtaatgctcacttgcagagcgcatctggaagattaaatatcaactccggatcggatgatcccaacgacatgggattagatggtgacgactacgatgccaaagacgacgatgatttggatgagagtggtgacggctcaggggggccctacgaggtggaagaaggcgcaggcaatggagcagatcaaagcattggaaagggaaacggcaaagggaaacgaggacttcctgcgaaaaacctcatggctgagcgcaggcgccgcaaaaaactcaacgatcgcctgtacacgctacggtctgtagttcctaagattacaaagatggatagagcctccatattgggggatgcgattgagtacctaaaggagctcctgcaacgcatcaatgaaatccataacgaactggaagcagcaaagctggagcagtcgcggtcgatgccgtctagccccactccacgatccacccaaggttatccagctacagttaaagaagaatgccccgtcttgccgaatcctgaatcccagcctcctcgagtggaagtgaggaaaagagaaggtcaggccctcaacattcatatgttctgtgcccgccggcctggactcctcctctctactgtgaaggcgctggacgcccttggcttggatgtacaacaggctgtcatcagctgcttcaatggtttcgcccttgacctcttccgtgcagaggccaaagatgtggacgttggaccagaagaaataaaggccgttctgctgctcactgcgggatgtgatttgcactctttgcagtagatcccacaatgcagacggacaagttgaatgaattctcttcttttctgcatgggaaacaaaacacaaattgatacgagtgtggtttcaaagtctctcctcaccaggcagtgttcttcaattttcaccatacaagctaaaaaatttgacgctacctaaattcagtggtttgaacctgacattgttgtaggctgtactcagctttttctgtttttgtataacttagtatacggtaaaggcccacagagcagagaacggtgggaccttcacggtactgccactagaccaagccttgaaaacgttatgcaggtgaaatgtttctgtacatcatcttcaagacttgtgtgctgtgtgtgcctctatgtgtttgcctatgtaaccaagttgtccgttgctatccaacacctgccaggcttgtcgggtctgtgtgaggaggctgaataaagcgtgaaacctttcgtgtcgtaaaaa

SEQ ID NO: 334 - DNA, 637 bp, Zea mays
gagcttttctccatcgtgctctcctccgcctccggtcaccattaacctagccgccactctcctcggtgcggcggagcccgcctgcccggatcccggacaccggggcgacctcaagtgttccacatgcatcatgggacacgacgctcaccgctcgctatcgctggcggactacggacggctggagctggatttctgtggagaagtggattgctgactgctgtggagaatttcggactttgaagcctgaagtgtgaagtatgaaccatctgtgaagtccaaactgtatttttcttgtggatttgtgatgcaatgcaatggcacttggcggctgtcactggcaggcaacagcagcaccgcagcaggcttaatgccttgcagccttgcacttttgtatcttttgtcgtcgtcgagtactcagtacattagtgtagtagtaggtagtacctgtcggctgtattggttcttgaattctcgctcctctgcataaggtttgttatctatactagattatgatcttaagatgttctgttagtagtaattcattaatctgcgttttgttcagtgagctgttgctttctgtatatgcattttgttcttgttacaatgtgcattcagatatggaggtacttgtgctttt

SEQ ID NO: 335 - DNA, 3214 bp, Zea mays
ctgcactctccccactcaacaatcaaccacggcgtcacaaccgcacccctccgaaccctagctagcaccgcgcgccggagccccggagtaggtgcctgcttgccctcctgcggtggccgtcgcgctgccgccgcctgatccgattcgtctagccgtgtcaagcgccaccaccggtgatcgatgcgaggcgccgcgggaggcggctcgggctcgggcaggctgtgaggagaggctgtccgctcgctgcgtcgtgcgcctgtctgcgcgcgcgtctgctccgccgtccgcgccaagccgtccctcgccgaggggggctgcctctcacggccgctcggcctcgccgcgcgtctgcttcccaccacccacgcagggatcctcgcgggctggaggtcgaagcgcgagcggagagctaagagcaacaaggcgacgagatttgtgtggctacgattttgcgttgccgacggaacatgggaacaatggttgcagcggtggcgttgcgagggggaagcagcgatagcggaggatttgataaggttcccgggatggactcgggaaaatacgtgcgctacaccccggagcaagttgaggtgctcgagcggctctacatagattgccccaagccaagctcctcacggcggcagcaactgctgcgcgagtgtcctatactctccaacattgagccaaagcagatcaaggtctggttccagaaccggaggtgccgcgataagcagcggaaggagtcttcgcggcttcaggctgtgaacagaaagttgacggcaatgaacaagcttctaatggaagagaatgagcggcttcagaagcaagtctctcagttggttcatgaaaacgcgcacatgcggcagcagctgcagaatacttcattggccaatgacacaagctgtgaatcaaatgtcactacccctccaaaccctataagggacgcaagtaacccttctggactccttgcgattgcagaggagaccttcacagagttcctctcaaaggctactgggacagctattgattgggtccagatgcctgggatgaagcctggtccggattcagttggtatcgtggccatttcgcatggttgccgtggcgttgctgcccgcgcctgtggtttggtgaatctagaaccaacaaaaggcatagagatcttgaaagatcgtccctcttggttccgtgattgccgaagtcttgaagtgtttacaaggtttccagctggaaatgggggaacaattgaacttatttacatgcagatgtatgccccaacaactttagtccctgcacgtgatttttggacactacgatacacgacaacaatggaagatggcagccttgtggtctgtgagagatccttgagtggttctggtggtggtccaaatgcagcctctacacaacaatttgttagggctgagatgcttccaagtgggtatttagttcgcccatgcgaaggtggaggatcaattgtgcatatagtggaccatctagatctcgaagcatggagtgttcctgaagtgcttcgaccactgtatgagtcttctagagttgttgctcagaaaatgactactgtggcactgcgccaccttagacaaattgctcaagaaacaagtggagaagtagtgtacgccttgggaaggcaacctgcagtcctacggacctttagtcaaagactaagcagggggtttaatgatgccattagcggtttcaatgatgatggctggtctgtaatggggggagatggcattgaagacgttgttattgcttgcaactcaaccaagaaaattaggaataccagcaatgctgggattacatttggagccccaggaggcattatttgtgcgaaggcatccatgttactgcagagcgtcccaccggcagtactggtacgatttctgagggagcatagatctgaatgggctgattacaatattgatgcgtatttggcttcatcattgaagaccagtgcgtgctcacttcctgggttgcgacccatgagattttctgaggggcagatgatcatgccacttgctcacacagttgagaacgaggagattcttgaagttgtccgccttgaaggtcagcctcttactcatgatgaagctcttctttcaagggacatccaccttctccagctttgcactggaatagatgagaaatctgtgggttcctccttccagcttgtgtttgcaccaattgatgagcatttcccagatgatgctccattgatttcttctggctttcgtgtcataccacttgatgtgaaaacagatggtgtatcctctggtaggacgctagatttggcatctagtcttgatgtgggctctgctgcaccccaagcctcaggggatgcatctccagatgactgcaatttgagatctgtgctgacaatcgcctttcaattcccgtatgagatgcaccttcaggacagcgttgcagcaatggcccgtcaatatgttcgtagtgtcatttctgctgtgcaaagagtgtcgatggctatatctccctcccaatctggtctaaatgctgggcataggatgctttctggcttccctgaagctgccacacttgctagatgggtttgccagagttatcactaccatctaggtatggaattacttaatcaatcagatggagctggtgaagcattgttgaaaatgctctggcatcatccagatgctgttctgtgctgctcctttaaggagaaacctatgtttacgtttgcaaacaaggcagggctggacatgttagaaacatctcttgttgccctgcaagacctgacgctagacaagatcttcgacgagtcaggaaggaaagcactattctcagacatctcgaaactaatggaacagggctacgcgtacctgccgtcaggcgtgtgcatgtcaggaatgggccgccatgtttctttcgaccaagctgtagcgtggaaggtgctcggcgaggatagcaacatccactgcctggcgttctgcttcgtcaactggtccttcgtgtgactgacgcccaacccgtcgggtggttatggcgagctgaccctttttttgtatggaaaatcatcagctgtgacaaaaggcatatgttgcatgcactagttgaagaaactggtccaaatgctttttttgtttgtcattccattcagatgttgctaggtgtggagtggaaatggggcaatagtgtcacggttacacatgacccagcattaccaaaaaaa

SEQ ID NO: 336 - DNA, 2758 bp, Zea mays
cgcgagatttgcgcggctacgattctgcgttgccgagggagcaagggaaccaatggctgcagcggtggcgatgcgagggggaagcagcgacagcggaggatttgacaaggttcccgggatggactcggggaaatacgtgcgctacaccccggagcaagttgaggtgctcgagcggctctacatcgattgccccaagccaagctcctcacggcgccagcaactgctgcgcgagtgtcctatactctccaacattgagccgaagcagatcaaggtctggttccagaaccgaaggtgccgcgataagcagcggaaggagtcttcgcggcttcaggctgtcaacagaaagctgacggcaatgaacaagcttcttatggaagagaatgagcgtcttcagaagcaagtctctcagttggttcatgaaaatgcgcacatgcggcagcagctgcagaacacttcattggccaatgatacaagctgtgaatcaaatgtcactgcccctccaaacgctataagggatgcaagtaacccttctggactccttgcgattgcggaggagaccttcacagagttcctctcaaaggctactgggacagctattgattgggtccagatgcctgggatgaagcctggtccggattcggttggtattgtggccatttcgcatggttgccgtggcgttgctgcccgcgcctgtggtttggtgaatctagaaccaacaaaagtcatagaaatcttgaaagatcgtccctcttggttccgtgattgtcgaagtctggaagtgtttacaatgtttccagctggaaatgggggaacaattgaacttatctacatgcagatgtacgccccaacaactttagttcctgcacgtgacttttggacgttgcgatacacgacaacaatggaagatggcagccttgtggtctgtgagagatccttgactggttctggaggcggtccaaatgcagcttctgcacagcaatttgttagggctgagatgcttccaagtgggtatttagtgcgcccatgcgaaggtggaggttcgattgtgcatatagtggaccatctagatctcgaggcatggagtgttcctgaagtgcttcgaccactatatgagtcttctagagtagttgctcagaaaatgactactgtggcactgcgccaccttagacaaattgctcaagaaacaagtggagaagtagtgtatgccttgggaaggcaacctgcagttctacggacctttagtcaaagactaagcagggggtttaatgatgccattagtggtttcaacgatgatggttggtctgtaatggggggagatggcattgaagacgttgttgttgcttgcaactcaaccaagaaaattaggaataatagcaatgctgggattacatttggagcgcctggaggcattatttgtgcgaaggcatccatgttactgcagagcgtcccaccggcagtactggtccgatttctgagggagcatagatctgaatgggctgattacaatattgatgcgtatttggcttcatcactgaagaccagtgcgtgctcacttcctgggttgcgacccatgagattttctggggggcagatgatcatgccacttgctcacacagtggagaacgaggagattcttgaagttgtccgccttgaaggacaacctcttactcatgatgaagcccttctttcaagggacatccaccttctccagctttgcactggaatagatgagaaatctgtgggttcctccttccagcttgtgtttgcaccaattgatgagcattttccggatgatgctccattgatttcctctggctttcgtgtcataccacttgatatgaaaacagatggtgtatcctctggtaggacgctagatttggcatctagtcttgatgtgggttctgctgcaccccaagcctcaggggatgcacctccagatgactgtaatttgagatctgggctgacaatcgcctttcaattcccttatgagatgcaccttcaggacagtgttgctactatggcccgtcaatatgtgcgtagtgttgtttctgctgtgcaaagggtgtcgatggctatatctccctcccaatctggtctaaatgctgggcagaggatgctttctggcttccctgaagctgccacacttgctagatgggtttgccagagttatcactaccatctaggtgtggaattactcaatcaatcagatgaagctggtgaagcattgttgaaaatgctctggcatcatccagatgctgttctgtgctgctcttttaaggagaaacctatgtttacgtttgcaaacaaggcagggctcgacatgttagaaacatctcttattgcgctgcaagacctgacgctagacaagatcttcgacgagtcaggaaggaaagcaatattctcagatatctcaaaactaatggaacagggctacgcgtacctgccgtcgggcgtgtgcatgtcaggaatgggtcggcatgtctcattcgaccaagctgtagcgtggaaggtgctcggcgaggacagcagcgtccactgcctggcgttctgcttcgtcaactggtccttcgtttgacacgccatcccatggcctgtgtgatgagcaggccaatttttttgtatggtgatcccaatatggggaaaccatcagctgtgacagaaggctttatgttgcatgcactagttgtacgtcttgaatccagtgtatttatgaagaaattggatactgcgcaaagtctggtgccacttacgtttgact

SEQ ID NO: 337 - DNA, 926 bp, Zea mays
ctccaccactgcccactcccatcccacgcgagcacaaccaccacctactccctactccctacactactccccccgcaagcacgcccagcgccatggccatggcggcagcgcgcacgggggcctgctactccgcctccgcttcctctcctctcctgcactactagcgggtccgctggcgacgatggcggcggtggcgagcagggagaggctctccccgggcgccgcgccgcaggtggacgcgggcaagtacgtgcggtacacgccggagcaggtggaggcactggagcgcgtctacagcgagtgccccaagcccagctcgctgcgccggcagcacctcatcagggactgccccatcctccgcaacatcgagcccaagcagatcaaggtctggttccagaaccgcagatgccgggagaagcagcgcaaggagtcctctcgtctacaaaccgtgaaccggaagctgagtgcgatgaacaagctgttgatggaggagaatgaccggctgcagaagcaggtttcccgtctcgtctttgacaacgggtatatgaagaatcgactccacagtccttctgtagccaccaccgacacaagctgtgagtctgtggtgacaagtggtcagcacaaccaacagcaaaacccagcagttctgcatcctccacaaagggatgcgaacaacccagcaggtctactcgctattgctgaggagacattggcagagttcatgtccaaggcgactggaactgctgtcaactgggtgcaaatggttgggatgaagcctggtccggattccgttggaatcatcgctgtttcgcacaactgcagcggcgtagcagcacgagcttgcggccttgtgagccttgagcccacaaaggttgctgagatcctttaggatcgtgcatcgtggtatcgcgattgtcggcatgttg

SEQ ID NO: 338 - DNA, 590 bp, Zea mays
ccacagtccttctgtagccaccaccgacacaagctgcgagtctgtggtgacaagtggtcagcacaagcagcagcaaaacccagcagttctgcatcctccacaaagggatgcgaacaacccagcagggtaataagtctggaacacggttgcatttcgttttcaaactctatgcctgctctaatgctagtttcccagtctactcgctattgctgaggagacattggcggagttcatgtccaaggcgaccggaactgctgtcaactgggtgcagatggttgggatgaagcctggtccggattccgttggaatcatcgctgtttcgcacaactgcagcggcgtagcagcacgagcttgcggccttgtgagcctcgagcccacaaaggttgccgagatccttaaggatcgcgcatcgtggtatcgcgattgtcggcgtgttgatatcctccatgttatccctacgggtaacggtggaacgattgagctgatctatatgcagacttatgcactgacaactctggcggaaccgcgcgacttttggacactacgatacactagtggtcttgacgatggcagtcttgtgatctgcaaaa

SEQ ID NO: 339 - DNA, 818 bp, Zea mays
  misc_feature (805)..(805): n is a, c, g, or t
gccgctgctcctctcctctcctctcctcgctagctccccccaagcgagcacgccgcccaccacgatgccagcgcgcacgggagccggctgctccgcctccgcctcctctccgctcccgcaccactagcgcgggagcccgatggcgagcagcagggggaggctgaggctctccccgcgcgcggcggcgccgcagctggacgcgggcaagtacgtgcggtacacggcggagcaggtggatgcgctggagcttgcctacggcgagtgccccaagcccagctcgctgcgccggcagcagctcatccgggactgcgccgtcctcaccaacgtcgagcccaggcagatcaaggtctggttccagaaccgcagatgccgggagaagcagcggagggagtcctctcgtctgcagaccgtcaaccggaagctgggtgccatgaacaagctgttgatggaggagaacgaccggctgcagaagcaggtgtcccgtctcgtcttcgacaacgggtatatgaagaatcggctccacagtccttctgtagccaccaccgacacaagctgcgagtctgtggtgacaagtggtcagcacaagcagcagcaaaacccagcagttctgcatcctccacaaagggatgcgaacaacccagcaggtctactcgctattgctgaggagacattggcggagttcatgtccaaggcgaccggaactgctgtcaactgggtgcagatggttgggatgaagcctggtccggattcccgtggatcatcgctgtttcgcacactgcagcggcgtacagcacgagcttgcggncttgtgagcctcg

SEQ ID NO: 340 - DNA, 1125 bp, Zea mays
cacagacacaaataaaaagaaatcagtagttcgatttctcctctcacctttacacatatctccgtatttacaaattaggttgttgatgtaggctgtacgcacctgctggtttgctactcgatcctatatatcgtccaatcctatctgacctctcgacatctggtccttgattactcgtcctttttgcttggtgcctgtgtatatcgtcgccccggccgcttgagctagcttcctctagtgctcgctctcgtcgtcgatcggttgtttgcatagcccacggcgagccgaagcaatgtcgtcggcgcccctgcagatcgcgccggtgccggagcatgtgtgctacgtgcactgcaacttctgcaacacaattctcgcggtcagtgtcccgagtcacagcatgctgaacatcgtcacagtccgttgtgggcactgcactagcctgctgtcggtgaacttgagaggactcatccaatcacttcctgtccagaaccaccactactcccagcagcaggagaatttcaccgtccaaaatatgggttttactgaaaattaccctgagtacgcaccttcgtaccgcatgccaacgacgctgtcagcgaaaggtgatctggatcatatgctgcacgtgcgcgctccagagaagaggcagcgtgttccttcagcatataacagatttattaaggaggagatacgaaggattaaagcatgtaacccggacataagccatagggaagccttcagcactgcagcaaagaattgggcacattttccgaatattcattttggtctagggccctgtgaaagtagcaacaatcttgatgaggccaccggtgcaatgtgccatccccagaaagtccaagatctctactaagacctatatcagcactgccctttgtttcctcttagttctggactagttggtgagtgccatatatatatgcatgagtgtgatatgatcatgaggtaaggaattatgattaagatgatatatatgtacgagatgaacatgcccctaggttcatgaaagactaaataaggatcgtcatctcaccatgttatcataggtagtaactattgtttgaaataaattatcctttgtgtgcagttttagtgtttgtttatgcc

SEQ ID NO: 341 - DNA, 971 bp, Zea mays
ctctctctctcacacacacacacagacacaaataaaaagaaatcagtagttcgatttctcctctcacctttacacatatctccgtatttacaaattaggttgttgatgtaggctgtacgcacctgctggtttgctactcgatcctatatatcgtccaatcctatctgacctctcgacatctggtccttgattactcgtcctttttgcttggtgcctgtgtatatcgtcgccccggccgcttgagctagcttcctctagtgctcgctctcgtcgtcgatcggttgtttgcatagcccacggcgagccgaagcaatgtcgtcggcgcccctgcagatcgcgccggtgccggagcatgtgtgctacgtgcactgcaacttctgcaacacaattctcgcggagaatttcaccgtccaaaatatgggttttactgaaaattaccctgagtacgcaccttcgtaccgcatgccaacgacgctgtcagcgaaaggtgatctggatcatatgctgcacgtgcgcgggtcaaatgactgtggattttttgtgatgagttacatgaagtcttatgatcacaatgcaggtgtcatatcttctttcaatcaactagacaattcccgagacctacgtgctcatgcccttcatcaactcacattcaatcgcatcaacaaggtgttgccacttccattagatatccagagatttatgtttgcgcgcaattagtgaaatatgtcagaactaagcaatggtgtgggcaatgtaccgtactgtggtattttggccattattgtcagttaacaattgtaagaagcttccttatatgtgctgtttcagaacaaatgtcatgctactttgtcttaggggtgttacccaggttctttctgtgaactttagttggctggatacttatggttatgttgcgaatatgtgaacatcatatgttttcacttctgggtgctttaaatatgatctgtttt

SEQ ID NO: 342 - protein, 149 aa, Zea mays
MLPCHDAQTQRASGACMSEAAAAALVHHAAAAKSGQPSFQEAKAAVIIFVVVVVVTMMMVMVVVMVVVTVMVIPTLRRRIAVGLLAVVKVALVPRRWLLRRRVVRPLRWSLGRWVRLRVPWWRIGLRDLLVTHGSVVALAVPRSDRFSL

SEQ ID NO: 343 - protein, 99 aa, Zea mays
MSSYKKLSQIKKRRLTLHFNLLQKAAEERKIDLLAPAHSGRSRAANQSEMQAQSTLVRSLGVESWATNHTVIVCTHAQVEEAPVSNCVQQVKESRLSLA

SEQ ID NO: 344 - protein, 275 aa, Zea mays
MLLPSSSSASASASASASKGNSFGKTVNDHLRSTLSFDNKQPPFASQNFDYGQTIACISYPYNRSRSGDVWAAYESRTSTATVFRSQIAGGGSSTRIPLPLELAENEPIYVNPKQYHGILRRRQLRAKLEAQNKLVRARKPYLHESRHLHAMKRARGSGGRFLNTKQLQQSHTALTRSNTTSGTSSSGSTHLRLGGGAAAAGDRSVLAPKTMASQDSSKKAVSSALAFTVTPMLRRDDGFLQHPSHLFSFSGHFGQASAQAGVHNGSQHRVPVMR

SEQ ID NO: 345 - protein, 301 aa, Zea mays
MCLLREMEDHYVHPKSKSNHGSLSGNGYEMKNPGHEVCDRDSSSESDRSHPEASAVSESSLDEHTSTQSDNDEDHGKDNQDTLKPVLSLGKEGSAFLAPKIDYNPSFAYIPYTADAYYGGVGVLTGYAPHTIVHPQQNDTTNSPVMLPAEPAEEEPIYVNAKQYHAILRRRQTRAKLEAQNKMVKGRKPYLHESRHRHAMKRARGSGGRFLNTKQQPQEQNQQYQASSGSMCSKTIGNSVISQSGPICTPSSDAAGASAASQDRGCLPSVGFRPTANFSEQGGGGSKLVVNGMQQRVSTIR

SEQ ID NO: 346 - protein, 300 aa, Zea mays
MPVILREMEDHSVHPMSKSNHGSLSGNGYEMKHSGHKVCDRDSSSESDRSHQEASAASESSPNEHTSTQSDNDEDHGKDNQDTMKPVLSLGKEGSAFLAPKLHYSPSFACIPYTSDAYYSAVGVLTGYPPHAIVHPQQNDTTNTPGMLPVEPAEEPIYVNAKQYHAILRRRQTRAKLEAQNKMVKNRKPYLHESRHRHAMERARGSGGRFLNTKQLQEQNQQYQASSGSLCSKIIANSIISQSGPTCTPSSGTAGASTAGQDRSCLPSVGFRPTTNFSDQGRGGLKLAVIGMQQRVSTIR

SEQ ID NO: 347 - protein, 300 aa, Zea mays
MPVILREMEDHSVHPMSKSNHGSLSGNGYEMKHSGHKVCDRDSSSESDRSHQEASAASESSPNEHTSTQSDNDEDHGKDNQDTMKPVLSLGKEGSAFLAPKLHYSPSFACIPYTSDAYYSAVGVLTGYPPHAIVHPQQNDTTNTPGMLPVEPAEEPIYVNAKQYHAILRRRQTRAKLEAQNKMVKNRKPYLHESRHRHAMKRARGSGGRFLNTKQLQEQNQQYQASSGSLCSKIIANSIISQSGPTCTPSSGTAGASTAGQDRSCLPSVGFRPTTNFSDQGRGGLKLAVIGMQQRVSTIR

SEQ ID NO: 348 - protein, 244 aa, Zea mays
MRQNGAVMIQFGHQMPDYDSPATQSTSETSHQEASGMSEGSLNEHNNDHSGNLDGYSKSDENKMMSALSLGNPETAYAHNPKPDRTQSFAISYPYADPYYGGAVAAAYGPHAIMHPQLVGMVPSSRVPLPIEPAAEEPIYVNAKQYHAILRRRQLRAKLEAENKLVKSRKPYLHESRHLHAMKRARGTGGRFLNTKQQPESPGSGGSSDAQRVPATASGGLFTKHEHSLPPGGRHHYHARGGGE

SEQ ID NO: 349 - protein, 249 aa, Zea mays
MLPPHLTENGAVMIQFGHQMPDYDSPATQSTSETSHQEASGMSEGSLNEHNNDHSGNLDGYSKSDENKMMSALSLGNPETAYAHNPKPDRTQSFAISYPYADPYYGGAVAAAYGPHAIMHPQLVGMVPSSRVPLPIEPAAEEPIYVNAKQYHAILRRRQLRAKLEAENKLVKSRKPYLHESRHLHAMKRARGTGGRFLNTKQQPESPGSGGSSDAQRVPATASGGLFTKHEHSLPPGGRHHYHARGGGE

SEQ ID NO: 350 - protein, 143 aa, Zea mays
MLPPHLTENGAVMIQFGHQMPDYDSPATQSTSETSHQEASGMSEGSLNEHNNDHSGNLDGYSKSDENKMMSALSLGNPETAYAHNPKPDRTQSFAISYPYADPYYGGAVAAAYGPHAIVSDLHASSLLFHYLLPVLDDALCPL

SEQ ID NO: 351 - protein, 816 aa, Zea mays
MSSSSAASIGQPPPPAPPPEEEKKCLNSELWHACAGPLVCLPTVGTRVVYFPQGHSEQVAASTNKEVDGHIPNYPNLPPQLICQLHDVTMHADVETDEVYAQMTLQPLNPQEQNDAYLPAEMGIMSKQPTNYFCKTLTASDTSTHGGFSVPRRAAERVFPPLDFTQQPPAQELIARDIHDVEWKFRHIFRGPKRHLLTTGWSVFVSAKRLVAGDSVLFIWNEKNQLLLGIRHATRPQTVMPSSVLSSDSMHIGLLAAAAHAAATNSRFTIFYNPRASPTEFVIPLSKYIKAVFHTRISVGMRFRMLFETEESSVRRYMGTITEVSDADPVRWPSSYWRSVKVGWDESTAGERPPRVSLWEIEPLTTFPMYPSLFPLRVKHPWYSGLAALHDDSNALMWLRGVTGEGGFHSLNFQSPGIGSWGQQRLHPSLLSNDHDQYQAVVAAAAASQSGGYLKQQFLHLQQPMQSPQEQCNLNPLLQQQILQQASQQQMVSSDAQNIQSVLNPGAIQQQLHQLQQMQHTHNDQKQKIQPDQQYQVASSAVLPSPTSLPSHLREKFGFSDPNVNSSSFISSSSNENMLESNFLQVSSKSVDLSRFNQPVVSEQQQPQQQQAWKQKFMGSQSMSFGGSVSLNSPTSKDGSVDNKVGRDVQNQSLFSPQVDSSSLLYNMVPNLTSNVADNNISAFPSGSTYLQSPMYGCLDDSSGLLQNTGENDPTTRTFVKVYKSGSVGRSLDITRFSNYAELREELGQMFGIKGQLDDPDRSGWQLVFVDRENDVLLLGDDPWESFVNSVWYIKILSPEDVHKMGKPGNDPRYLS

SEQ ID NO: 352 - protein, 821 aa, Zea mays
MSSSSGASIGQPPPPPPAPPPEEEKKCLNSELWHACAGPLVCLPTVGTRVVYFPQGHSEQVAASTNKEVDGHIPNYPNLPPQLICQLHDVTMHADVETDEVYAQMTLQPLNPQEQNDAYLPAEMGIMSKQPTNYFCKTLTASDTSTHGGFSVPRRAAERVFPPLVISHSSLQHRSLLHGIFMMSSGNSGISSEASQPKRHLLTTGWSVFVSAKRLVAGDSVLFIWNEKNQLLLGIRRASRPQTVMPSSVLSSDSMHIGLLAAAAHAAATNSRFTIFYNPRASPSEFVIPLSKYIKAVFHTRISVGMRFRMLFETEESSVRRYMGTITEVSDADPVRWPSSYWRSVKVGWDESTAGERPPRVSLWEIEPLTTFPMYPSLFPLRVKHPWYSGVAALHDDSNALMWLRGVAGEGGFQSLNFQSPGIGSWGQQRLHPSLLSNDHDQYQAVVAAAAASQSGGYLKQQFLHLQQPMQSPQEQCNLNPLLQQQILQQASQQQMVSPDAQNIQSVLSPNAIQQQLHQLQQMQHAHNDQKQKIQPDQPYQVPSSAVLPSPTSLPSHLREKFGFSDPNVNSSSFISSSSNENMLESNFLQGSSKSVDLSRFNQPVVSEQQQQQQQQAWKQKFMGSQSMSFGGLVSLNSPTSKDGSADNKIGRDVQNQSLFSPQVDSSSLLYNMVPNLTSNVADNNISVIPSGSTYLQSPMYGCLDDSSGLLQNTGENDPAARTFVKVYKSGSVGRSLDITRFSNYAELREELGQMFGIKGQLDDPDRSGWQLVFVDRENDVLLLGDDPWESFVNSVWYIKILSPEDVHKMGKPGNDPRYLS

SEQ ID NO: 353 - protein, 326 aa, Zea mays
MVSSDAQNIQSVLNPGAIQQQLHQLQQMQHTHNDQKQKIQPDQQYQVASSAVLPSPTSLPSHLREKFGFSDPNVNSSSFISSSSNENMLESNFLQVSSKSVDLSRFNQPVVSEQQQPQQQQAWKQKFMGSQSMSFGGSVSLNSPTSKDGSVDNKVGRDVQNQSLFSPQVDSSSLLYNMVPNLTSNVADNNISAFPSGSTYLQSPMYGCLDDSSGLLQNTGENDPTTRTFVKVYKSGSVGRSLDITRFSNYAELREELGQMFGIKGQLDDPDRSGWQLVFVDRENDVLLLGDDPWESFVNSVWYIKILSPEDVHKMGKPGNDPRYLS

SEQ ID NO: 354 - protein, 326 aa, Zea mays; identical to SEQ ID NO: 353

SEQ ID NO: 355 - protein, 122 aa, Zea mays
MYGCLDDSSGLLQNTGENDPTTRTFVKVYKSGSVGRSLDITRFSNYAELREELGQMFGIKGQLDDPDRSGWQLVFVDRENDVLLLGDDPWESFVNSVWYIKILSPEDVHKMGKPGNDPRYLS

SEQ ID NO: 356 - protein, 534 aa, Zea mays
MAKDLHGNEWKFRHIFRGQPKRHLLTTGWSVFVSAKRLVAGDSVLFIWNDNNQLLLGIRRANRPQTVMPSSVLSSDSMHIGLLAAAAHAASTNSRFTIFYNPRASPSEFVIPLVKYVKAVYHTRISVGMRFRMLFETEESSVRRYMGTITGICDLDSVRWPNSHWRSVKVGWDESTAGERQPRVSLWEIEPLTTFPMYPSPFPLRLKRPWPTGLPSLHGGKDDDLANSLMWLRDTANPGFQSLNFGGLGMSPWMQPRLDATLLGLQPDMYQAMATAAFQDATKQASPTMLQFQQPQNIAGRASPLLSSQILQQAHHQFQQQPYLQNISESTIQAQGQSEFLKQQIQRSQSFNEQKPQMQHQQESQQQQQPQCLPVPQHQQMQQQNMTNYQSISNALSPFSQLSPVSQSSPMALQTILPFSQAQSFTDTNVGSLSPSNGNTMQNTLRPFSSEAVSHLSMPRPTAIPVADPWSSKRVAVESLLPSRPQVSSQMEQLDPAPASIPHSSALAPLPGRGCLVDQDVNSDPQIISCSVLV

SEQ ID NO: 357 - protein, 821 aa, Zea mays; identical to SEQ ID NO: 352

SEQ ID NO: 358 - protein, 821 aa, Zea mays; identical to SEQ ID NO: 352

SEQ ID NO: 359 - protein, 326 aa, Zea mays; identical to SEQ ID NO: 353

SEQ ID NO: 360 - protein, 816 aa, Zea mays; identical to SEQ ID NO: 351

SEQ ID NO: 361 - protein, 122 aa, Zea mays; identical to SEQ ID NO: 355

SEQ ID NO: 362 - protein, 534 aa, Zea mays; identical to SEQ ID NO: 356

SEQ ID NO: 363 - protein, 368 aa, Zea mays
MERLGVGVGVGELPPGFRFHPTDEELITYYLLCKAVDGGFCGGRAIAEIDLNKCEPWELPGKAKMGEKEWYFYCLRDRKYPTGLRTNRATAAGYWKATGKDREVRSGRSGALVGMKKTLVFYRGRAPRGQKTRWVMHEYRLDGTYAYHFLPGSTRDEWVIARVFQKPGEVPCGRKHRLGGPSAAAGDSCFSDSTTSASIGGGGGGGASASSRPLLTVTDTSSPSLFVANANAAASNNNGNPVTGRELVPCFSTTASPLEAAALGVVGHPYNAAPLRLGLDFEAPSPGFVVPNLRSLQVQDDGGLPLFLSAAAGGGMSSATLGIMGSLGGSLHCPPHAGMDVVKVEGRAAPPQMAVGPGLLDGAFAWGF

SEQ ID NO: 364 - protein, 358 aa, Zea mays
MERFGLDGGGGGGELPPGFRFHPTDEELITYYLLRKAVDGSFCGRAIAEIDLNKCEPWELPGKAKMGEKEWYFYSLRDRKYPTGLRTNRATVAGYWKATGKDREIRSGRTGALVGMKKTLVFYRGRAPKGQKTHWVMHEYRLEGAYAYHFLPSSTRQDEWVIARVFQKPGEVPPAARKHRLGALSSTTGTAAGDSCFSDSTSASIGGASSSSTPGPLFASAAAAVANAGAADGDTSSYCGGAANHGNLVTGRELVPCFSTATINGPLVAAALGIGQPYNAAPLPFEQQPPPPAFLPSLRSLQDNLQLPPFLSAGGLGGGGALHWLPAGGMEVKVEGRSAPPQMAVGPGQLDGAFGWSF

SEQ ID NO: 365 - protein, 305 aa, Zea mays
MMAIKSLSMVEASLPPGFRFHPRDDELVLDYLAKKLGGGGGPVVVSIYGCPTMVDVDLNKCEPWDLPDIACIGGKEWYFYSLRDRKYATGQRTNRATDSGYWKATGKDRPISRKGLLVGMRKTLVFYQGRAPKGKKTEWVMHEFRMEGRDDPMKLPLKEDWVLCRVFYKSRATVAKPPTESSSFNIDAATTSLPPLIDNNFNISFDQPGSSSVQNLEGYEQVPCFSSNPSQQPSSSMNAARLPPSAAMADPEQQMGKSIIKDVLMSQFSRFEGSVKREAPPSNFSQDGFEYLAESGFTQMWNSFN

SEQ ID NO: 366 - protein, 153 aa, Zea mays
MHACLGIGCTRHRANLRPLLRNPTGVHQTSGRTIPAERLPPLSTGPSSSPPPAPAAYHCCRCPYYYCHYYGHHRPAASCSSCSLLPVSPSTTDDEDNDRPSVSLRPLPLIFRQRGQDRELMVGVLRSPAASSLRTVPAVDRPDRAAWLAGLNS

SEQ ID NO: 367 - protein, 362 aa, Zea mays
MSQRKGAMAAAVTASKHREDQEAMMVELRRGPWTLEEDNLLMNYIACHGEGRWNLLARCSGLKRTGKSCRLRWLNYLKPDIKRGNLTPEEQLLILELHSKWGNRWSRIAQHLPGRTDNEIKNYWRTRVQKQARQLRVDANSAVFRDAVRCYWMPRLLEKMAAHHHGDGELPPPLHPSHNIAGTASSRSPPAHGSQQEDPSSSAPAASGHYLQQVDPSPSTSTTSGSTTSAALPPVPCFSESELRWVVDQYGAAYGYTDDLDLDGGAGVVDDDSAAAAALDSLGLDGLDLGPADGGVYSDATLLDYLNATCAGGTTVMTMMGGVHGAAGGGDGDYGPSPWRTDELGQTARKLGDPQHQWRGGI

SEQ ID NO: 368 - protein, 48 aa, Zea mays
MNASWYLESQVSGQEQVPLEEAHGGCCAVFVRCLGRRLPVDLCAKDDP

SEQ ID NO: 369 - protein, 159 aa, Zea mays
MAVTPWLLLSSSRAPGRCPRWPSVLPYRLAREGCRVRPRRELPGVASRPSSLLGVRLLTRALLPWPHAHLSVRLCAQLPKLHGRFPARVVVSQLVSTCSSRLGSLRLKFQRLALLSWFSDGRREPDRGGVVAWRRRARRDSCLGREVVRAIEFARPRSR

SEQ ID NO: 370 - protein, 171 aa, Zea mays
MRRPSPRPRRAPLLPGSRAQLPLFRAPPASPWPGLHPLPARHGWSSFFPATKLPWPPSSAFAPPCVARLACSPAPVHARILFLPGARPHLHLPASALPKPSHGVVPPWCRVSLCQSPMAPSRLAFLVLALPQCPVPCTTPFLLQFVFFYSWPLFTSPSSTSPRPHPLQGQP

SEQ ID NO: 371 - protein, 205 aa, Zea mays
MASSWGSRLPLAVVLLLVACFSSTAAATSYTVGDGSGWTTGVDYTSWAASKNFKVGDNLVFNYAKGLHTVVEVSAAEYMACTAANPLGSDSSGATTVALRTPGTHYFVCSITGHCGAGMKLAVTVGGSNSPAATPRTSSPTPTTPYTTPATTTPYTTPTCSGGGGTTATPGMTPFTSYPSAAGLGSAALAGFSLVWCVGVRLALL

SEQ ID NO: 372 - protein, 298 aa, Zea mays
MREQDLQELYGGLNSRSELKLSPAPTECRDESVDEGLKTSYSREGNCVNRDNYNGLDINALPPDDDGDIAKDKESSPGSEWQSELGQSSDHNNGVNTTDEMYNGAHYISHNQKSTGRKVGIKPQEEKSEKADCSGTCAYLKGSSEDNPEMPIVESSEEQSTGGALWDIFRRQDSDKLQDYLRKHCSEFRHIYCNPVKKVFHPIHDQSFYLTEEHKRKLKEEYGIEPWTFEQKLGEAVFIPAGCPHQVRNLKSCIKVALDFVSPENVGECVKLTEEFRRLPSFHKAKEDKLEVSNVHLQ

SEQ ID NO: 373 - protein, 348 aa, Zea mays
MEHDVHHQHQQAMELPPGFRFHPTDEELITHYLARKAADARFAPRAVGEADLNKCEPWDLPSRATMGEKEWYFFCVKDRKYPTGLRTNRATESGYWKATGKDREIFRSKALVGMKKTLVFYTGRAPRGGKTGWVMHEYRLHGKHASSSRLMPSSVRAGASKDEWVLCRVFKKSIEPPPSVGKRSSVACTGTMVVEDVVGPPSMSMEDDLTACALPPLMDVSGGGGANMAAASIELLAPPAPHVTCFSNALEGQFFLNPPCLHPSTSPLRLASMVQAQAQAQYDGDAGMVLQLLQEAGGWYSKLGEGERLSGGASQDTGVTSEVNVNPAEISSTRHHIMDPEAASFWGF

SEQ ID NO: 374 - protein, 378 aa, Zea mays
MATGGGSSRSDDVRGLKFGKKIYFEQDGGSGSGAGAVGGRKGKGVATGGARPASAASAAQPPRCQVDGCGVDLSAVKQYYCRHKVCNMHSKEPRVFVAGIEQRFCQQCSRFHQLHEFDQGKRSCRRRLIGHNERRRKPPPGPLTSRYGRLAASLQEPGRFRSFLLDFSYPRVPSSVRDAWPGIQHGGDRMLGTVQWHGHQEPPHPHRSAAAGYGNHAAYNCHGGLVAGGAPMLSSAAFELPPGGCVAGVAADSSCALSLLSTQPWDTTSHDHRSPAMPAAGAFDGTPVAPSVMASSYAASSAWTGSRDPAADGARNAQRLDDALHLVHPGSAAVHFSGELELALQGSGGPPHLPRVDHGGSGGGTFNHSTTSAMNWSL

SEQ ID NO: 375 - protein, 193 aa, Zea mays
MEWTVPKRAASPPSPPLLWDWGGDHAGATGSGSGSSGDAPARRGGREREAKRARADDGEVRCQVEGCGLDLSRVKEYHRKHRVCEAHTKSPRVVVAGQERRFCQQCSRFHALSEFDQKKRSCRRRLSDHNARRRKPQPDAFAFASARLPSSSFADFPGRKRRGLLPKDKSISLFPDFSSCYLHNKFSNMIGGK

SEQ ID NO: 376 - protein, 403 aa, Zea mays
MDWDAKMLPAWDLGTVVGPSSSGGVGVGGGGALDLKLGAPTSSRVVATAAAAVGAAPTLPSANHPPPPAPAPAPAPSSSAPAKRPRPGHAQQAVPACSVQGCDADLSRCRDYHRRHKVCEAHSKTPVVTVAGQQQRFCQQCSRFHLLGEFDEVKRSCRKRLDGHNRRRRKPQPDPLNPAGLFGNHHGVTRFTSYPQLFTTSMAEPKWSVVKTETDVFQDQYYPAVHLDGAGAGSLFHGKDRKHFPFLTNHNNGGGDVAAAALGCQPFTITTTASSESSSKQSNGNCALSLLSDNPTPAQTAMIPTAQPLGPAMQYGRLPGSGGGSGDVSLTGMSYMRVADSRQASMLTTSSPSHTAVASPGPATAAATQHQLQYHHGYYHVSGGEQGNNPDGAAIQALPFSSW

SEQ ID NO: 377 - protein, 193 aa, Zea mays; identical to SEQ ID NO: 375

SEQ ID NO: 378 - protein, 231 aa, Zea mays
MIHYQKKSTSRSTLDYTSLLGHQAPRNTRSTTTGATYIMAVTLVDRVAITAHELHQWAPTRPSRYIPTRRHPWSRCESETPRARPLRHCWPQRCAGGGGSGGGACCRLHKVQRRRVPRARRRHVVVLVPTTTAATATATVGVGVRVPAGCVVVVGRVLLLLEGATRRRRGDEIPSGRRRAVGDEVLPREERGGAVLGDKVVERRAGARRDVLPRRRDQPGPAGARHAASGR

SEQ ID NO: 379 - protein, 329 aa, Zea mays
PSTAPAPARCQVDGCNVDLTDVKPAYYCRHKVCKMHSKEPRVLVNGLEQRFCQQCSRFHQLPEFDQLKKSCRKRLAGHNERRRRPPPGPLASRYGRHAASLGEPGRLRSFMLDFSYPRVSSAMRGGFPAVRPGGERVPGGIQWQAGLDPRHHQGAVAGYGAHYGSEGGSSSSARPPVFPGPELPPGGCLAGVPADSSCALSLLSTQPWDAAHSHSHSHAAPTAGFDGGSPVAPSLMAASSYIAPSPWTETDSWGHEGGRSVPQLPPDDVPLGEVHSGSSSHHGQFSGELELALQGNRPAPGSAAPPAPRNNQGSAGTFDQAGNTMDWSL

SEQ ID NO: 380 - protein, 479 aa, Zea mays
MGSFGMDWNQKASVLWDWENLPPVAVGASGSENPRMAAAPQALHSACGTISSSSEMGYGSSKSSVSASADDSSPKAKGKSMELNFAPDKVPDKNTDSGKVDDARTSPSSPVIAISSAEPVLSLKLGKRTYFEDVCGGQSVKSLPSDTSAVTPPPASPKKTKVTPNKKSYCQVEGCKVDLSSAKEYHRKHRVCEPHSKAPKVVVAGLERRFCQQCSRFHGLAEFDQKKKSCRRRLNDHNARRRKPQPEALSFGSSRLSAMFYDTRQHTSLLFGQGPYGQMRSCASSSWDNPGGGFKFAETKGPWLRAGGVDGLHQPSQQVWNNFMPHGVHQDFDGFTAFKGTNAKVLHQGVEASAVASNQNGAPQPDLHRALSLLSNSWAGGGTGTGTDQHPTAQLRHAALSSSLAASSVSVAQASPAGLWQDGGAALGHHDYAHAFQAINTPGGGGAAAPIAVGQELLQLPRPPSLYDDGSSSRYDLMR

SEQ ID NO: 381 - protein, 253 aa, Zea mays
MHMPIRCFPNLLFFFWSEPGRFRSFLLDFSYPRVPSSVRDDAWQWQGMQHGGDRMLLGTASAIQWHGNQEPHPPHRSAAAGYGNHAYNNCHGGGGLVAAAAGASMLSSAFEPPPGGGGCVAGATAADSSCALSLLSTQPWDTPTQSGSSHHNRSPAMSAAAGAFEVAPSSVVASSYTASSSWSGSRDPADGARKNAQRHDDGLHLVHPPGPVHHGHFSGELELALQGSGPPHVDHGGGTCFSHSDTNAMNWSL

SEQ ID NO: 382 - protein, 267 aa, Zea mays
MSSGSFMTSQQGTRFSSFPVPRPEPSWPGVIKSEDSGSYYAHQRHPVLSSRPHFAGGGSTPPAYSSKEGRRFPFLQDGCDQQQVGGFSAGAGAQQLEVSSTSTVCQPLLKAAAAAAPPPPPESSSSNKMFSDGLAPAVLDSDCALSLLSSPANSSSVDVGRMVVHQPAEHIPMAQPLVPGGLQQQQQHHPFGGSPAWFACSQAGSSAVSAGGFACPPGVESEQLNTVLVPSSDGGGHDMNMNYHGIFHVGGDGSSDGTSPSLPFSWQ

SEQ ID NO: 383 - protein, 333 aa, Zea mays
MDGGGGAGGAEGELTAQETALYDRQIRVWGVDAQKRLSKAHVLVCGMNGTTIEFCKNIVLAGVGSLSLMDDNVVTEEDLNANFLIPPDESIYGGRSRAQVCCESLIDFNPMVRVSVEKGDPSLIDGEFLDKFDIVVLSRASLKTKLLINENCRKRSKHIAFYTIDCKDSCGEIFVDLQKHSYVQKKPGGATEQQELTYSSLQEAISVPWNSLPKKTAKLYFAMRVLEDYELSEGRSPGETTLSDIDAVLARRKDMCDKMSLNESRIPTTLVERLLAAGKKEHPPVCAILGGILGQEVIKSISCKGDPVKNFFYFDVADGKGVIEDIPPPPPAK

SEQ ID NO: 384 - protein, 415 aa, Zea mays
MTTAIAIEDVRREVRILSSLTGHSNLVQFYDAFEDEDNVYIVMELCKGGELLDRILARGGKYSEEDAKVVMVQILSVVSFCHLQGVVHRDLKPENFLFSSKDENSPLKVIDFGLSDFVKPDERLNDIVGSAYYVAPEVLHRSYATEADMWSIGVIAYILLCGSRPFWARTESGIFRAVLKAEPSFDEAPWPTLTAEAKDFVKRLLNKDYRKRMTAAQALSHPWIRNSQQVKVPLDMIIYKLMRAYISSSSLRKSALRALAKTLTTDQLFYVREQFELLGPNKNGYISLQNLKSALAKNSTDAMKDSRVVDFVNTVCALQYRKLDFEEFAASAISVYQMEALETWEQHARRAYELFDKEGNRPIVIEELASELGLGPSVPLHVVLQDWVRHADGKLSFLGFIKLLHGVSSRSIPKA

SEQ ID NO: 385 - protein, 352 aa, Zea mays
MKVLCSACEAAEARLLCCADEAALCARCDRDVHAANRLAGKHHRLPLLPPDDVSAPNCDICQEAHAYFFCVEDRALLCRACDMAVHTANAFVSAHRRFLLTGVQVGLQPAAAAQDADPHPPAAAEPLQTPPPPDRKAAAAGDGSSPALLYSDDDIDWAAGADAGGGVSVAVTLPDWSLVHEQFGAPPVVPRHADPALARTPSSKRSPRRSVAAAFTVQGGGGLAGGLPDWPLDEFFGFSEYSAGLAFAENDTSKADSGKLGSTDGSPAGRPSSDASQDFFGQVPEFHQWSVPELPSPPTASGLHWQGGPRHGAATTTDVAAVFVPDISSPENPFWCYATAAGQAPTKRRRRC

SEQ ID NO: 386 - protein, 352 aa, Zea mays; identical to SEQ ID NO: 385

SEQ ID NO: 387 - protein, 352 aa, Zea mays; identical to SEQ ID NO: 385

SEQ ID NO: 388 - protein, 352 aa, Zea mays; identical to SEQ ID NO: 385

SEQ ID NO: 389 - protein, 121 aa, Zea mays
MAQGRGSATRGLALGALLAAAFLLLLGVADAATHRVDWSFNADSWSKGKSFRAGDVLEFNYDPSVHNVVAVDAGGYNGCRPSGTSYGSGSDRITLGPGTSYFICSLNRHCGMGMKMVVNAS

SEQ ID NO: 390 - protein, 178 aa, Zea mays
MAASRSALITLLVLVSSVAAASATTFTVGDSSGWSRSVNYDNWASGKTFTDGDQLVFNFATGNHDVVEVDKSGYDGCSTTNAANTIQNGPATVNLTSGTHYYICGISGHCSGGMKLAVTVGSGSGSGSGSPTPGGGSPSTPTPTTPSAPAPDTPAGASVRLTAGPALAVAATVLVALF

SEQ ID NO: 391 - protein, 176 aa, Zea mays
MAASRSALITLLVLVSSVAAASATTFTVGDSSGWSRSVNYDNWASGKTFTDGDQLVFNFATGNHDVVEVDKSGYDGCSTTNAANTIQNGPATVNLTSGTHYYICGFTGHCSAGMKLAVTVGSGSGSGSPTPGGGSPSTPTPTTPSAPTPDTPASASVRLTAGPALAVAATVLVALF

SEQ ID NO: 392 - protein, 516 aa, Zea mays
MATATYLSSSFSSPPPPSSRARLRRQTTRAGASAATDRPREVLSPKRRLPLREVPGDYGPPVLGAVRDRFEYFYGPGGRDGFFASRVRAHGSTVVRLNMPPGPFVARDPRVVALLDAASFPVLFDTSLVDKTDLFTGTFMPSTDLTGGYRMLSYIDPAEPSHGPLKALLFYLLSHRRQHVIPKFREVYGDLFGVVENELARVGKADFGHHNDAAAFSFLCQALLGRDPAESALHGDGPKLITKWVLFQLSPLLSLGLPKHLEDSLLHSFRLPPALVRKDYGRLADFFRDAARTVVDEGERLGIAREEAVHNILFATCFNSFGGMKILFPSLVKWLGRAGARAHGRLATEVRDAVRAHAGEVTMKALAEMPLVESAVYEALRIEPPVAMQYGRAKRDMVVESHDYGFEVREGEMLFGYQPMATKDPRVFARAEEYVPDRFLGEDGAQLLRHVVWSNGPETASPTLQDKQCAGKDFVVLIARLLVAELFLRYDSFDVQVGASALGSSVTITSLKKATF

SEQ ID NO: 393 - protein, 182 aa, Zea mays
MAAIMAAGLVVLALLAAVAAPAHATDYVVGDSAGWASGVDYATWASGKTFAAGDNLVFQYSAMHTVAEVSSADYSACSASNSIQSYSDQNTKVALTAPGTRYFICGAPGHCGNGMKLTVTVAAAAATTTPETSTSTPAATTPPTTTKSTSTSSTSSTGAAAVGRPGSVWAFWPRPRASPGSP

SEQ ID NO: 394 - protein, 360 aa, Zea mays
MKEAGEERCLDPQLWHACAGGMVQMPPVRSRVYYFPQGHAEHAHGGGGATDLAGARARPLPPLVLCTVAGVRFLADPETDEVFAKIRLVPAAPGEVEFGEPREFGIDPEDAREKLSSFAKTLTQSDANNGGGFSVPRYCAETIFPKLDYRADPPVQTVLAKDVHGEVWKFRHIFRGTPRRHLLTTGWSAFVNQKKLVAGDSIVFLRTEHGELCVGIRRAKRVSCGGMECISGWNAPVYGALSAFLKDEEGKITKGPGGYMRGRGKVEITDVVEAASLAASGQPFEVVYYPRASTPEFVVKAASVQNAMRNQWCPGMRFKMAFETEDSSRISWFMGTIASAQVADNQMAKFTVEASSGVMG

SEQ ID NO: 395 - protein, 698 aa, Zea mays
MITFVDSAAMELERESGRCLVDPQLWHACAGGMVQMPPVHSRVYYFPQGHAEHAQGHAHADLPAGRVPALVLCRVDAVRFLADPDTDEVLARVRLAPVRPNEPDHADAAAPGAREDKPASFAKTLTQSDANNGGGFSVPRYCAETIFPRLDYSADPPVQTVLAKDVHGVVWKFRHIYRGTPRRHLLTTGWSAFVNQKRLVAGDSIVFMRTGGTGDLCVGIRRAKKGGIGGGPEFPHHQPPDGGGYGYGYAGFSTFLRGEEDDEGQGQGAGAAGGGRRGRQPRGERAAVRGGLYLPKANTQSCASRRGRSAHHVTQWCAGMRFKMAFETEDSSRISWFMGTVAAVQVADPIRWPNSPWRLLQVAWDEPDLLQNVKRVSPWLVELVSSTPAIHHLTPFSPPSRKKLCIPLYPEGHQLPAPMFHGSPLVGRGVGPMRYFPDGGTPPAGIQGARHAQFGISLPDLHHLTRLQSSLSPHAHGLRHQLDHGARPRIAGGLIVGHPAARDDISCLLTIGTAPHKKPSDVKSAAAAPAPQLMLFGKPILTEQQISLGFRPLPAPKKSPSDDAAETERTVSNNSDASSPAGTASGSTPSISGGAPSSCQDNKAAATATATDDDDLLGHCKVFMQSEDVGRTLDLSAVASYEELYQRLADMFGVDRAELTSHVFYRDGASGALKHAGDEPFSEFTKTARRLTIQTDAR

SEQ ID NO: 396 - protein, 716 aa, Zea mays
MERERESDRCLDPQLWHACAGGMVQMPAVHSKVYYFPQGHAEHAQGPVDLPAGRVPALVLCRVAAVRFMADPDTDEVFAKIRLAPVRPNEPGYADDAIGAAAASGAQEDKPASFAKTLTQSDANNGGGFSVPRYCAETIFPRLDYSADPPVQTVLAKDVHGVVWKFRHIYRGTPRRHLLTTGWSTFVNQKKLVAGDSIVFMRTENGDLCVGIRRAKKGGIGGPEFMHHHHQQPPPPQGGGYAGFSMFLRGEEDGGKMMAAAATRGKAARVRVRPEEVVEAANLAVSGQPFEVVYYPRASTPEFCVKAGAVRAAMRTQWCPGMRFKMAFETEDSSRISWFMGTVSAVHVADPIRWPNSPWRLLQVAWDEPDLLQNVKRVSPWLVELVSNMPVIHHLTATPFSPPRKKLCVPLYPELPLEGQFPAPMFHGSPLLGRGGAGGPMCYFPDGTPAGIQGARHAQFGISLSDLHLNKLQPGLSPHGLHRQLDHGVQVQVQQPRIAAGLIVGGHPAARDDVSCLLTIGTPKSKKPPSDVKKASTAAAPQLMLFGKAILTEQQISLGGGNVVPALAKKSPSDDDDDVAERTVSNSDVSSPGRSNQDGTSSGGGPAARACWQEEECNNRAAGSEDDLLGHCKVFMQSEDVGRTLDLSAVASYEELYQRLADMFGVDKAELTSHVFYRDDASGALKHPGDEPFSEFTKTARRLTILTDESSDSLAR

SEQ ID NO: 397 - protein, 681 aa, Zea mays
MKEVAEERCLDPQLWHACAGGMVQMPPVRSRVYYFPQGHAEHAHGGGAADLAGARALPSLVLCSVTGVRFLADPETDEVFAKIRLVPVAPGEVEFREPDEFSVDPADAREKLSSFAKTLTQSDANNGGGFSVPRYCAETIFPKLDYRADPPVQTVLAKDVHGEVWKFRHIYRGTPRRHLLTTGWSTFVNQKKLVAGDSIVFLRTEHGELCVGIRRVKRVSCGGMECMSGWNAPGYGALSAFLKDEEGKMMKSHGGYMRGRGKVKITDVVNAASLAASGQPFEVVYYPRASTPEFVVKAASVQNAMRNQWCPGMRFKMAFETEDSSRISWFMGTIASAQVADPIRWPNSPWRLLQVAWDEPDLLQNVKCVNPWLVEIVSSIPPIHLGPFSPPRKKLRVPHHPDFPFDGQLLNPIFHGNPLGPSNGGGALRCFSDIAPAGIQGARHAQFGLPLTDRQLNKLHLGLFQGGGFKRRLDAITPPCPISRGFVIGSAPVDESVSCVLTIGTPRAAERSDDRKKPHLMLFGKPILTEQQMSSRGSRETLSPEATGNSSDGSVQKTGNVSDGSGSSICIGSSSRGREASRLGFEFEAGHCKVFVESEDVGRTIDLSVFGSYEELYGQLADMFGIEKAEVMSHLCYRDAAGAVKRTGDEPFCDFMKVARRLTIVESTEGRLQKPLVEYMA

SEQ ID NO: 398 - protein, 707 aa, Zea mays
MITFADLTEPAAAGAERCVDRQLWLACAGSMCTVPLVGASVCYFPQGHAEHALGLDGAADLSAARVPALVPCRVTAVRYMADPDTDEVFARIRLVPLRGGEAHAGGLDDDVAAADEQEKPASFAKTLTQSDANNGGGFSVPRYCAETIFPRLDYAADPPVQNVVAKDVHGTAWKFRHIYRGTPRRHLLTTGWSTFVNQKKLIAGDSIVFLRGDSGDLHVGIRRAKRGFCGAGGGGGDEAPTPGWHHYAGLIRGNVSPCAAAKARGKVRPEDVAEAARLAAAGQSFEVVYYPRASTPEFCVRAAAVRAAMRVQWSPGMRFKMAFETEDSSRISWFMGTVAGVQVTDPIRWPQSPWRLLQVTWDEPDLLQNVKRVSPWLVELVSSMPAIHLASFSPPRKKPRIPAYPEFPFEGQLLNPAFPPSPLPHGQQHHHNFLHAHPPSFFPFPDGSAPAAIQGARHAQFVPSLSDLHLIHLQSSLLYPGLRRPDHVGPTIPIPSGISTDLTIGGAPARDGVPCALSVGASKQNPDAVKPAGLVLFGRTILTEHQMSLSSSGGATSPAATGNSSLCWTAEKGPNVSEGSGSGSGSGVIQNSPTGKNTSSERLPWFGDGSSQQASEPGLEPGQCKVFVESDTVGRNLDLSALGSFDELYGRLSEMFGVEGAEMRSRVLYRGATGEVRHAGDEPFSDFVKSARRITILTDAGSDNLGS

SEQ ID NO: 399 - protein, 197 aa, Zea mays
MESPPLTAEAIAFTEKKMDMTLEDIIKMSKKKNPGGKNPPRQPIKKRPFQNANTNKGNGKVQRFMESRSTIRQGVLAQRRSNLGGSQFAATKQAAKKAAAMPMRSGAVYWKKPSASTLVQRRSVGDAFQNTKVKESQNHAAPRTMDALFARMKAQRMRTAPQQQANPASGRDFNQQRRVQQQQRRGRAYGGRVVGNQ

SEQ ID NO: 400 - protein, 192 aa, Zea mays
MESPPLTAEAIAFTEKKMDMTLEDIIKMSKKKNPGGKNPPRQPIKKRPFQNANTNKGNGKVQRFMESRSTIRQRRSNLGGSQFAATKQAAKKAAAMPMRSGAVYWKKPSASTLVQRRSVGDAFQNTKVKESQNHAAPRTMDALFARMKAQRMRTAPQQQANPASGRDFNQQRRVQQQQRRGRAYGGRVVGNQ

SEQ ID NO: 401 - protein, 197 aa, Zea mays; identical to SEQ ID NO: 399

SEQ ID NO: 402 - protein, 66 aa, Zea mays
MTYLRFLRSREPSTRTLCPSCRIGTPRTRIPAPGPVWGARRSTTAWSRLSCQIHLSKDFWHHRSDP

SEQ ID NO: 403 - protein, 677 aa, Zea mays
MAEAGVARGSGSAGDALFRELWHACAGPLVTVPRQGELVYYFPQGHMEQLEASTDQQLDQHLPLFNLPHKILCKVVNVELRAETDSDEVYAQIMLQPQTEQSEPTSPDPEPPEPERCNIHSFCKTLTASDTSTHGGFSVLRRHAEECLPQLDMTQNPPWQELVAKDLHGNEWHFRHIFRGQPRRHLLTTGWSVFVSSKRLVAGDAFIFLRGENGELRVGVRRLMRQLNNMPSSVISSHSMHLGVLATASHAISTGTLFSVFYKPRTSRSEFVVSVNKYLEAKNHKMSVGMRFKMRFEGDESPERRFSGTIIGMGCMPANSTSPWANSEWRSLKVQWDEPSAILRPDRVSPWEVEPLDRTNPQPPQPPLRNKRARPPASPSIAPELAPVFGFWKSPAEPAQAFSFSGLQRTQELYHSSPSSMFSSSLNVGFNPKYEGPTPNTNHLYWTMRETRTESYSASINKAPTEKKQESTTSGCRLFGIEIGSSAVSPVVTVASVGHDPPPPALSVDAESDQLSQPSHANKATDAPAASSDRSPNETESRQARSCTKVIMQGVAVGRAVDLTRLDGYDDLRRKLEEMFDIPGELSASLKKWKVIYTDDEDDMMLVGDDPWSEFCRMVKRIYIYSYEEAKSLTPKAKLPAIGGDTGVKPDPSKLPPESDVPQSDSDNSAPVAADKD

SEQ ID NO: 404 - protein, 61 aa, Zea mays
MLILDMNHVNRCSRWHNNCRLSLVFMPRGHFLLLAGLAGDRAPHRRNVAELHRGFHYSAPS

SEQ ID NO: 405 - protein, 52 aa, Zea mays
MEATMKLCNVATVRSSVTGKPREQEEVSSRHEDQREPAVIMPPGASVHVVHV

SEQ ID NO: 406 - protein, 52 aa, Zea mays; identical to SEQ ID NO: 405

SEQ ID NO: 407 - protein, 446 aa, Zea mays
MAATRRAFFHSAVDGIARAGPGEAERLPAPPQVGRPVEGASSMVLGFPVPRPTMPDRRPAAVTQQFFPPTTTAAQQATMEEQCHVPAGSAAEQWVRSSASRKSRRGPRSRSSQYRGVTFYRRTGRWESHIWDCGKQVYLGGFDTAQAAARAYDQAAIKFRGLNADINFTLDDYKDEMKKMKDLSKEEFVLVLRRQGAGFVRGSSRFRGVTQHKCGKWEARIGQLMGKKYVYLGLYDTETEAAQAYDKAAIKCYGKEAVTNFDAQSYDKELQSQPWDGELDLELSLGCASSDPSTVAVEAFSPATSSSSRKQRTMTLTLGLPEEEETGAGYPHPAAGMFGRPADGHVHVAPPPHRQWQQQQQGQHAAPDAAPERRAAEPADRQRWGRGARWPIASASGINWAWAPPYATARAGTDDDDASSAAAAASSGFPLWQLGAASSRSSWPSC

SEQ ID NO: 408 - protein, 433 aa, Zea mays
MVLDLNVASPADSGTSSSSVLNSADGGFRFGLLGSPVDDDDCSGEMAPGASTGFMTRQLFPSPTPPAEPEPEPVAAPVPVWQPQRAEDLGMAQKPVAPAKNTRRGPRSRSSQYRGVTFYRRTGRWESHIWDCGKQVYLGGFDTAHAAARAYDRAAIKFRGLDADINFSLSDYEDDLKQMRNWTKEEFVHILRRQSTGFARGSSKYRGVTLHKCGRWEARMGQLLGKKYIYLGLFDSEVEAARAYDRAALRFNGREAVTNFEPSSYNAGDNNLRDTETEAIDDGDAIDLDLRISQPNVQDPKRDNTLAGLQPTCDSPESSNTMASQPMSSSSPWPGYHQNPAVSFHHQRLYSSACHGFFPNHQVQERPVERRPELGAQPFPSWAWQAQGSPHVPLHHSAASSGFSTAAGANGGMPLPSHPPAQFPTTTNPFFFP

SEQ ID NO: 409 - protein, 455 aa, Zea mays
MQLDLNVAEAPPPVEMEASDSGSSVLNASEAASAGGAPAPAEEGSSSTPAVLEFSILIRSDSDAAGADEDEDATPSPPPRHRHQHQQQLVTRELFPAGAGPPAPTPRHWAELGFFRADLQQQQAPGPRIVPHPHAAPPPAKKSRRGPRSRSSQYRGVTFYRRTGRWESHIWDCGKQVYLGGFDTAHAAARAYDRAAIKFRGVDADINFNLSDYEDDMKQMGSLSKEEFVHVLRRQSTGFSRGSSRYRGVTLHKCGRWEARMGQFLGKKAYDKAAIKCNGREAVTNFEPSTYHGELPTEVADVDLNLSISQPSPQRDKNSCLGLQLHHGPFEGSELKKTKIDDAPSELPGRPRQLSPLVAEHPPAWPAQPPHPFFVFTNHEMSASGDLHRRPAGAVPSWAWQVAAAAPPPAALPSSAAASSGFSNTATTAATTAPSASSLRYCPPPPPPSSHHHPR

SEQ ID NO: 410 - protein, 460 aa, Zea mays
MVLDLNAESPTPGSASAASSSSVVVGGGFFRFDLLGGTPDEEGCSPSPPIVTRQLFPLPYPDAAGSTAASTASNGSPPPEVAGAWARRPADLGAPALAQGKVMSAPSSPAVLSPAAGKKSRRGPRSRSSQYRGVTFYRRTGRWESHIWDCGKQVYLGGFDTAHAAARAYDRAAIKFRGLDADINFQLKDYEDDLKQMRNWTKEEFVHILRRQSTGFARGSSKYRGVTLHKCGRWEARMGQLLGKKYIYLGLFDSEIEAARAYDRAAIRFNGPDAVRNFDSVSYDGDVPLPPAIEKDVVDGDILDLNLRISQPNVHDLRSDGTLTGFGLSCNSPEASSSIVSQPMGPQWPVHPHSRSMRPQHPHLYASPCPGFFVNLREAPMQEEENRSEPACPQPFPSWAWQTQGSRAPVLPATTAASSGFSTAAATGVDAATAGHSVPPPSGSLRQFSGYHQLRFPPTA

SEQ ID NO: 411 - protein, 265 aa, Zea mays
MKQMCHLSKEEFVHVLRRQSTGFPRGSSKYRGVTLHKCGRWEARMGQFLGKKYVYLGLFDTEEEAARAYDRAAIKCNGKDAVTNFDPSIYAEEEVAPAAATGGAAGDEHNLDLSLGSSAGNKRGSLDGGGGGGGDDKSSDQRVPMAFDIDWQTAARRSTKAKLLSNGDPGTAAGGLSLAIGGGGGHWPPQLQHQQQQQRLHGARNNGGGTSWPPPPHPCPPPVPAAAATAAAASSRFHPYVVTSTTQSPAGWVQKNGFHSLARPT

SEQ ID NO: 412 - protein, 494 aa, Zea mays
MWDLNDSPAAEAAPPSPSADDSGASSSSAAALVEIPDDADDDSAAAAAEAVVTRQFFPAPAAVGAAPGPGSSSARAGWLRLAAAAPPPAAGGSNGVAQTGGPAAAAAAAGKKSRRGPRSRSSQYRGVTFYRRTGRWESHIWDCGKQVYLGGFDTAHAAARAYDRAAIKFRGVEADINFSLEDYQDDMKQMGHLSKEEFVHVLRRQSTGFPRGSSKYRGVTLHKCGRWEARMGQFLGKKYVYLGLFDTEEEAARAYDRAAIKCNGKDAVTNFDPSIYAEELEPAASTGGGGDDHNHNLDLSLGSSAGNKRGSLDDGGGGGGGGDDETSDQRVPMAFDVDWQTAAPRSTKAKLDASSKQPQTQMLPPPPPAVLRVAHQLPLPFGPRHPQSQFLSNGGDPGTSGGLSLAIGGAGGGHWPPQLQHLQQQRLHGAWANGGGTSWPPPPHPHPHPHPPPPSTAATAAAASSRFPPYVVTTTQGPAGWAQKNGFHSLARPT

SEQ ID NO: 413 - protein, 186 aa, Zea mays
MAPSAALAPVAFRSAFSTPLASNPTRNRINIEGTFCLPCSARKRASYRSFRVYSLFGGKKDKDENGDEAPSKAGIFGNMQNLYETVKKAQMVVQVEAVRVQKELAATEIDGYCEGELIKVTLSGNQQPIRVEITEAAMELGAEKLSELVNDAYKDAHQRSVQAMKERMSDLAQSLGMPAGLGDGLK

SEQ ID NO: 414 - protein, 721 aa, Zea mays
MRAAPFSADGNGAGTIEALLWPHGKGGGGGHLLLEPTSVLDCRRSPSPPYSTSTLSSSLGGAAGDSFSGVAAVSENSAAAAAEATKWAAPGEHGSGGGGGGSGGGRKEEWPGGDLPPIPGALDIGFVGEEGWDAMLGDAAAAAGQDQTFLNWIMAAPGDMEPPPPPPPLLGNAAGFGFPAPDPLGFSLQHHPGGGGASAGALASDLSSPGARSLSGSSGSGSKATSTFGLLPTEAVLQPPPPPAATTMRFHDGADIKPPLLGVPSAGLLHQHQTLPAASFFMPLPSFPDHQHQPHLPPPPKRHHSMPDNLFLLQNQLQPPPSQGLPFPPLHTTTPFQLQPPLQPPRGAMKTTPAAQQHQQLLDELAAAAMAAEVGNSIGAREILARLNQQLPPIGKPLLRSASYLREALLLALTDGHQGSTRVTSPLDVALKLGAYKSFSDLSPVLQFANFTATQALLDEIASTTSSCIRIIDFDLGVGGQWASFLQELAYRRGTGNGPLPMLKLTAFVSSASHHPLELHLTRENLSQFAVDLGIPFEFTAINLDAFDPAELIAPSADEVVAVCLPVGCSARTPPLPMLLQLVKQLAPKIVVAIDHGSDRGDLPFSQHFMNCFQSCMFLLDSLDAAGTNADAASKIERFLIQPRVEDAVLGRRKAEKAMAWRAVFTSAGFAPVPLSNLAEAQADCLLKRVQVRGFHVEKCGMGLALYWQRGELVSVSAWRC

SEQ ID NO: 415 - protein, 507 aa, Zea mays
MTSALPHMSELPDGGAGGNGQDEAAAFASPAKRLRRSPALEPTSVLYNRSPSPPTSSSLVSSAAPEPPPISAEDWEAVLSGGDMAAPPAAARSQDASFLRWIMDADAQVDAFDPFLPCQETAVVEPFLQPQLPLPVADDLEPGATVDELLEAVRRADAGDSTGAREILARLNHRLPSPPGHPHPPILRAAAHLRDALLRVLVTSAPAPAAVSTTPLDVALKVAAHRALADASPTVQFANFTSTQALLDALGTARRVHVVDLDVGFGGRWAPLMQELALQWRRAPVSPLPPPCLKVTALVSPGSSAHPLELHLTHQGLTRFAADLGISFEFNAVAFDPLDPLPPTGLSVAPGDAVAVHLSVGSGVPSAATLRVVKQLRPAVVVCVDHGCHRGDLPLSHHALSVVRSSAAFLESLDAAGAPADAVARLEEYVVRPRVERLLLGDRMPPWRTMLDSAGFAPVQLSNAAEAQAECLVRRTPTPGFHVEKRQAALALRWQDSELVMVSAWRC

SEQ ID NO: 416 - protein, 479 aa, Zea mays
MGSPRRARRRREGGLGWQLPGLLHQYQHQPTPGTTFFMPIPSFPDPNQRSPLIQPPPKRPQSIGDDLYLARNRLLPPPAGQGHAFPPLNGPSPFQLQPSPPLSHGAMKTTAAEAAQQQLLDELAAAAKAAEAGNSIGAREILARLNHQLPLLGKPFLRSASYLKEALLLALAEGHHGGCHLTSPLDVALKLAAYKTFSDHSPVLQFTNFTATQALIDEIARSTSSCIHVIDFDLGVGGQWASFLQELAHRRGAGGAALPSVKLTAFVSAASHHPLELRLTRDNIAQFAADLGIPFQFSAISADTINPAELVSATADEVVAVVLPVGCSARAPPLPAILRLVKQLAPKIVIAIDHGADRADLPFSQHFLNCFQSCMFLLDSLDAAGIDADSTCKIEKFLIQPRIEDAVLGRGKVDKPIAWRSAFAAAGFAPVPPSNLAEAQADCLLKRVQVRGFHVEKCGVGLTLYWQCGELVTVSAWRC

SEQ ID NO: 417 - protein, 485 aa, Zea mays
MRPPPPPAATTMRFHDGADIKPPLLGVPSAGLLHQHQTLPAASFFMPLPSFPDHQHQPHLPPPPKRHHSMPDNLFLLQNQLQPPPSQGLPFPPLHTTTPFQLQPPLQPPRGAMKTTPAAQQHQQLLDELAAAAMAAEVGNSIGAREILARLNQQLPPIGKPLLRSASYLREALLLALTDGHQGSTRVTSPLDVALKLGAYKSFSDLSPVLQFANFTATQALLDEIASTTSSCIRIIDFDLGVGGQWASFLQELAYRRGTGNGPLPMLKLTAFVSSASHHPLELHLTRENLSQFAVDLGIPFEFTAINLDAFDPAELIAPSADEVVAVCLPVGCSARTPPLPMLLQLVKQLAPKIVVAIDHGSDRGDLPFSQHFMNCFQSCMFLLDSLDAAGTNADAASKIERFLIQPRVEDAVLGRRKAEKAMAWRAVFTSAGFAPVPLSNLAEAQADCLLKRVQVRGFHVEKCGMGLALYWQRGELVSVSAWRC

SEQ ID NO: 418 - protein, 153 aa, Zea mays
MEHDAPYGRQPLADMISVFACKFPDLNTYKSCDLLPSSWISVAWYPIYRIPTGPTLQDLDACFLTFHSLSTTPDGTISGCPETNNLHNSKVASVPGKITLPLIGLASYKLNGSLWTSNQHHEQQLTTSLLKAADDWLCQRQVDHPDYRFFLTH

SEQ ID NO: 419 - protein, 97 aa, Zea mays
MAARDYWLVNTHVHAQVRLRMENPCTWRHKFKPARFAVGTSDPSKITQCMYNAHTVQGDAENRKALTDHLHRPPLIHMDGVETWTMEQSAQGGRGIG

SEQ ID NO: 420 - protein, 547 aa, Zea mays
MAAGDLEVLTALDTAKTQWYHFTAIVVAGMGFFTDAYDLFCISLVTKLLGRIYYTVEGSATPGTLPPHVSASVNGVAFVGTLSGQLFFGWLGDKLGRKKVYGMTLMLMVLCSVASGLSFGHTPASVMATLCFFRFWLGFGIGGDYPLSATIMSEYANKKTRGAFIAAVFAMQGFGIMAGGLVAIVVSAWFKASFPAPAYAVDPAASTPPQADFVWRIILMLGAMPAALTYYWRTKMPETARYTALVAKNAKQAAADMSKVLQVEISAGAAEEGAAAATATATEPAPASASASFGLFSGEFLRRHGLHLLGTSLTWFLLDIAFYSQNLFQKDIFSAVGWIPKAATMNALEELFSIARAQSLIALCGTVPGYWFTVALIDVLGRFAIQVTGFLMMTVFMLGLAVPYEHWTTPGHHIGFIVMYGLTFFFANFGPNATTFIVPAEIFPARLRSTCHGISAASGKLGAIIGSFGFLYLAQNRDPAKTDHGYPAGIGVRNSLFLLAGCNLLGLAFTFLVPESKGKSLEEMSGENDEAAAAAATPNYNNRTVPV

SEQ ID NO: 421 - protein, 120 aa, Zea mays
MPAGYPWSVLAGSRFCARYRNPKEPTMAPSFPDAAEMPWHVDRSLAGKISAGTMNVVALGPKLAKKKVRPYMTMKPMWCPGVVQCSYGTASPSMNTVIIRNPVTWIANRPNTSISATVNQ

SEQ ID NO: 422 - protein, 547 aa, Zea mays; identical to SEQ ID NO: 420

SEQ ID NO: 423 - protein, 547 aa, Zea mays; identical to SEQ ID NO: 420

SEQ ID NO: 424 - protein, 81 aa, Zea mays
MYQYFTTRKYALYAQRKTHSQEMYAQICTICTNIIRLCSKYPTSYFTIQGYSYVNWLSNDTTWTDVNNMKMLLLPCSWMAI

SEQ ID NO: 425 - protein, 366 aa, Zea mays
MWTLPEASEIARPNANVEEGTVPIAAECGSKKVQEKQDYRDILQVQDSHHDVQTLDKTIASLETELSAARSLQESLLNGSPVAEEYKVSESIGRRKYLMVIGINTAFSSRKRRDSIRYTWMPQGEKRKKLEEEKGIIIRFVIGHSAISGGIVDRAIEAEDRKHGDFMRIDHVEGYLALSGKTKTYFATAVSLWDADFYVKVDDDVHVNIATLGQILSKHALKPRVYIGCMKSGPVLSEKGVRYYEPEHWKFGESGNKYFRHATGQLYAVSKDLATYISINKHILHKYINEDVSLGSWFIGLDVEHIDDRRLCCGTPPDCEWKAQAGNVCAASFDWRCSGICNSEGRIWEVHNKCAEGEKALWNATF

SEQ ID NO: 426 - protein, 98 aa, Zea mays
MAAVRSLLRSSASLLRAAPALARSSATTRPSLRRALAAPPRLLRSPVESSFCVESLLPLHTATAGARMTSMLAAPGQGLGWLTQGKKKQLLRSTTMTL

SEQ ID NO: 427 - protein, 90 aa, Zea mays
MAAVRSLLRSSASLLRAAPALARSSATTRPSLRRALAAPPRLLRSPVESSFCVESLLPLHTATAGARMTSMLAAPGQGLGWLTQAETDGV

SEQ ID NO: 428 - protein, 98 aa, Zea mays; identical to SEQ ID NO: 426

SEQ ID NO: 429 - protein, 74 aa, Zea mays
MAAVRSLLRSSASLLRAAPALARSSATTRPSLRRALAAPPRLLRYGPARRYSAACLLPDTVVSKTQSCGRLARW

SEQ ID NO: 430 - protein, 288 aa, Zea mays
MASAAVLRNAGSRRLFSYPTLRAAAISGPAVLPDAPVAASVAAQPPPLAWTLWAMSMATFTRTKPHVNVGTLGHVDHGKTSLTAAITKGISTTRNLLADDAMVPISSPLTPPLGDSEETDKKGAVVKRLKVQAIKKDIKQSPKKVNLVAKLVRGMRVEDALLQLQVTVKRAAKTVYQVIHSARANASHNHGLDPDKLIVEEAFVGKGLFLKRVSYHARGRSGIMVRPRCRLTVVVREATAEEEAKIAKLRVSNYKKLTRKEQQLMPHRLIEVSPRWIRKRKAEAGATA

SEQ ID NO: 431 - protein, 314 aa, Zea mays
MAACVDKWHPTHAGRLTGAIYRYLPDGATDRAVAAAAAAPASASGGDDDDVWDELRAEAQADADAEPLLRKYYADLVLSRPSLEAALAAHLSAKLCVPGALPQDALRDLLAAALAARPESGRAARADLRAARDRDAACGRMVHCFLYYKGFLALQAHRAAHGLWCEGRSAPAFLLQSRASEVFGVDIHPGARIGSGILFDHATGIVIGETAVVGNDVSILHGVTLGGTGKESGDRHPKVGDGVLIGAGASVLGNVRVGAGAKIGAGAVVLRDVPEGTTAVGNPAKAVGKKAAPQRRPEEQPGVTMEQGWSDYVI

SEQ ID NO: 432 - protein, 323 aa, Zea mays
MPAGQPHAHEAAAAACVGSGANHSNHRVPAHSPPPLPAEVVPAYPPPESEDDETWVWTQIKAEARRDADAEPALASFLYATVLSHPSLPRSLSFHLANKLCSSTLLSTLLYDLFLATLTAHPSLRAAVVADLLAAHSRDPACVGFSHCLLNYKGFLAIQAHRVAHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARSTAVGNPARLIGGKKAEGANEEDMPGESMDHTSFIRQWSDYTI

SEQ ID NO: 433 - protein, 323 aa, Zea mays; identical to SEQ ID NO: 432

SEQ ID NO: 434 - protein, 294 aa, Zea mays
MPAGQPHAHEAAAAACVGSGANHSNHRVPAHSPPPLPAEVVPAYPPPESEDDETWVWTQIKAEARRDADAEPALASFLYATVLFHLATLTAHPSLRAAVVADLLAAHSRDPACVGFSHCLLNYKGFLAIQAHRVAHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARSTAVGNPARLIGGKKAEGANEEDMPGESMDHTSFIRQWSDYTI

SEQ ID NO: 435 - protein, 409 aa, Zea mays
MDMASPALLTDDLLSDIFLRLAEPADLVRTAAACVPFRRLVADRAFLRRYRSLHPAPLLGFLDHNGFHPALPPHASAPAARAVSLAADFSFSFLPASSTGRGWVVRDVRDGRVLLDRSPEDRGDEPQVFTEIAVCDPLHRRCVLLPPVPVDLATAVEHPLRLEFDRWCEPFLVPHGADGEDETSFEVICMVQCKAKLVAFAFSSTTGEWRAVASMAWRDLMAGLGVSSRSPTFSGRQYARGCFYWVMDWRDKLLVLDAGRMEFSIADVPPSCHRRQIAVVEAGEGRVGMLALRDHVADGAVSLHYTVRRDDADGSNSNQWQVEKIIPLDPGFRYYIRGAMERYTLLLRFPEHLSLAGVHVSSSAVIEDLECFSMDTKTLQLERVCELNHHIMRAYVYTNFPPSLSPQSI

SEQ ID NO: 436 - protein, 487 aa, Zea mays
MAMQAAFLAGFSQLAAQPSRDCAVAVAPTRVAVAAVGSAKVGARVGLKAGIAAPAPAAGRGVRCRASLIEPDGGQLVDLVAPEEGGRRAALRREAAELPHRLRLGRVDKEWVHVLSEGWASPLQGFMREHEFLQTLHFNAIRGQDGRMVNMSVPIVLSVGDAQRRAIQADGATRVALVDERDRPIAVLSDIEIYKHNKEERIARTWGTTAPGLPYVEEAITNAGDWLIGGDLEIIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMSHPTEKRDLYDADHGKKVLSMAPGLERLNILPFKVAAYDTKQKKMDFFDPSRKDDFLFISGTKMRTLAKNRESPPDGFMCPGGWKVLVEYYDSLVPSEGSSKLREPIAA

SEQ ID NO: 437 - protein, 489 aa, Zea mays
MATQAAFLAGFSQLAAQPGRDRAVAVAVAPAPGPARVAVAAVGSAKLGVKAGTSRTAAVARLGVRCRASLIEPDGGRLVDLVAPEEGGRRAALRREAAELPHRLRLGRVDKEWVHVLSEGWASPLQGFMRDDEFLQTLHFNAIRGQDGRMVNMSVPIVLSVGDAQRRAIQADGATRVAVVDERDRPIAVLSDIEIYKHNKEERIARTWGTTAPGLPYVEEAITNAGDWLIGGDLEVIEPIKYNDGLDQYRLSPAQLREEFARRNADAVFAFQLRNPVHNGHALLMTDTRKRLLEMGYKNPVLLPHPLGGFTKADDVPLSWRMKQHEKVLEEGVLNPESTVVAIFPSPMHYAGPTEVQWHAKARINAGANFYIVGRDPAGMSHPTEKRDLYDADHGKKVLSMAPGLERLNILPFKVAAYDTKQKKMDFFDPSRKDDFLFISGTKMRTLAKNRESPPDGFMCPGGWKVLVEYYDSLVPSEGSSKLREPIAA

SEQ ID NO: 438 - protein, 489 aa, Zea mays
MATQAAFLAGFSQLAAQPGRDRAVAVAVAPAPGPARVAVAAVGSAKLGVKAGTSRTAAVARLGVRCRASLIEPDGGRLVDLVAPEEGGRRAALRREAAELPHRLRLGRVDKEWVHVLSEGWASPLQGFMREHEFLQALHFNAIRGQDGRMVNMSVPIVLSVGDAQRRAIQADGATRVALVDERDRPIAVLSDIEIYKHNKEERVARTWGTTAPGLPYVEEAITNAGDWLVGGDLEVIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMSHPTEKRDLYDADHGKKVLSMAPGLERLNILPFKVAAYDTKQKKMDFFDPSRKDDFLFISGTKMRTLAKNRESPPDGFMCPGGWKVLVEYYDSLVPSEGSSKLREPVAA

SEQ ID NO: 439 - protein, 322 aa, Zea mays
MMMTRAPMGPMEGAAVDEMVRRLVEGGRGGRQVQLSEAEIRQLCVEGKRVLLSQPNLLRIHAPVKICGDIHGQFVDLLRLFDLGGYPPASTYVFLGDYVDRGKQSLETICLLLAYKIRYPENIFLLRGNHEDAKINRVYGFYDECKRRFNVRLWKIFSDCFNCLPIAALIDDKILCMHGGLSPELTSLDQIKDIERPAEIPDYGLLCDLLWSDPSPDGEGWGESDRGVSCTFGADKLVEFLEKNDLDLICRAHQVVEDGYEFFAQRRLVTIFSAPNYCGEFDNVGALLSIDESLMCSFQILKPTDMGPPHARKQIPNKPTRG

SEQ ID NO: 440 - protein, 81 aa, Zea mays
MQNEEGKTVDLYVPRKCSATNRIITAKDHASVQINIGHLDANGLYDGHFTTFALSGFVRAQGDADSSLDRLWQKKKVDIKQ

SEQ ID NO: 441 - protein, 81 aa, Zea mays; identical to SEQ ID NO: 440

SEQ ID NO: 442 - protein, 123 aa, Zea mays
MLVSYLLLSSSSCPVCVPPLGLALWPWIANAPLRVQSTSVLSCFPVFKNAVGRSKQASSNPMEVESALRCHATQLHVHQVQESGGYLPIRDQPLPERQGTMAACLMSTRHEQQQPPAGQRPGF

SEQ ID NO: 443 - protein, 1109 aa, Zea mays
MVRKKRTGPGESSGEASGAPGQGSSQRPQATQQGARGGGQHQGRGGYQGRGAPPSQHPGGGLTEYQPRDYQGRGGYQGRGGPPSQVPGGGPPEPQPRAYQGHGGYQGRGGPPSQHPGGGPPPGSQPRDYQGRGGPRPRGGMPQPHRGGHVGGSVGPSVPSGPSRPVPELHQAPDVQHQAPVVATPSPQGAGSSSQPRKAEVSTGQVQQQLQQLVIHDQSSASQAGQVAPASSKAVRFPLRPGKGTHGSRCIVKANHFIAELPNKDLHQYDVSITPEVTSRGVNRAVMGELVNLYRHSHLDGRLPAYDGRKSLYTAGALPFTSKTFEITLQDEEDSHGGGQRRQRVFRVVIKFAARADLHHLAMFLAGRQPDAPQEALQVLDIVLRELPTARYCPVGRSFYSPNLGRRQQLGEGLETWRGFYQSIRPTQMGLSLNIDMSSTAFIEPLPVTEFVAQLLNRDISVRPLSDSDRVKIKKALRGVKVEVTHRGNMRRKYRISGLTSQATRELSFPIDDRGTVKTVVQYFLETYGFSIQHTTLPCLQVGNQQRPNYLPMEVCKIVEGQRYSKRLNEKQITALLKVTCQRPHEREKDILQTVHHNAYSEDPYAQEFGIRIDERLASVEARVLPPPKLKYHDSGRERDVLPRVGQWNMMNKKMVNGGRVSSWACINFSRTVQDGAARSFCHELALMCQVSGMDFALEPVLPPCYARPEHVERALKGRYQDAMNILRPQDRELDLLIVILPDNNGSLYGDLKRICETDLGLVSQCCLTKHVFKANKQQYLANVALKINVKVGGRNTVLVDALTRRIPLVSDVPTIIFGADVTHPHPGEDSSPSIAAVVASQDWPEVTKYAGLVSAQTHRQELIQDLFKVYQDPQRGSVSGGMVRELLISFWRSTKQKPKRIIFYRDGVSEGQFYQVLLHELDAIRKACASLESDYQPPVTFVVVQKRHHTRLFANNHNDQRAVDKSGNILPGTVVDSKICHPTEFDFYLCSHAGIQGTSRPAHYHVLWDENKFTADGLQTLTNNLCYTYARCTRSVSIVPPAYYAHLAAFRARFYMEPDTTDSGSMASGATTSRAPGGARNTRAGVGNVAVRPLPALKENVKRVMFYC

SEQ ID NO: 444 - protein, 1109 aa, Zea mays; identical to SEQ ID NO: 443

SEQ ID NO: 445 - protein, 742 aa, Zea mays
MPHPTDPEAGSEQKAEAPAVPLAAAAPAPVKKKRNLPGTPDPDAEVIALSPGTLLATNRFVCEVCGKGFQRDQNLQLHRRGHNLPWRLRQRGPGAPPPRRRVYVCPEPACVHHSPARALGDLTGIKKHFCRKHGEKRWACPRCAKRYAVQADLKAHAKTCGTREYRCDCGTLFTRRDSFVTHRAFCGALGEETGRVLAPPAPPSPRPPDLEADENVADLEADENVDKDNDKEGEEENEDSAVAEVEEPRRVEVVPEEPQRIPSPPPLPKEPPCRPSPPPLPQEQLSPPPSPKEPPCCHPSPPPLPKEPQRLPFPPEQHAVVVALVPNVDEPEVVAVPSVTAELEDETDQDEDACFQEADQYKDSELEVSNLLDKDTPMLPCFLASPSEAIGTDGSGTTTCGAGGSVSNSIAPSTTTNTFAGLFASATTSTTSHSTSLRDLIGVDPTFLCLAIGAPSLFPQTSASNSGTFALLPPAPHMSATALLQKATEAGATQSSSSFLKEFGLASSSSSSSSQPSSKQVPQGRVGAADTSAEPPWPYRSNQQVDMERRQSHQRREMESCSQQWHPSSTQQTEMERRHRNHHQEREMESSSQQWHRHHRNDRQMGSESYRSNQQMQMESSSHQWLQHRSSEQMVGRRHHLERVESRGMLLSGGGLGLGLAYESGKSGLPDLMTGPSPSPSPLLGPKPATLDFLGLGIGGTMVGSTGLPALVAGGELDMGSSAQVPAPWDDAQRKANGRTIL

SEQ ID NO: 446 - protein, 432 aa, Zea mays
MDWDLNAAGAWDLAELERDHAAAAPSSGGHAANAAAAGTGTESRPPAPGAAGAPAECSVDLKLGGMGECEPGAARREREAAAGAAKRPRPAGPGGQQQQQQCPSCAVDGCRADLGKCRDYHRRHKVCEAHSKTPVVVVAGREMRFCQQCSRFHLLAEFDADKRSCRKRLDGHNRRRRKPQPDTMASASFIASQQGTRFSPFAHPRLEASWPPGVMKTEESPYHITHQIPLGSSSSSRQQHFVALGAATPAYAKEGRRFPFLQEGEISFATGVVLEPPAAAPACQPLLRTGAPSESSGAGGSKMFSDQGLARVLDSDCALSLLSAPANSSGIDVSRMVRPTEHVPMAQQPVVPGLQFGSASWFPRPQASTGGSFVPSCPAAVEGEQQLNAVLGPNDSEVSMNYGGMFHVGGGSGGGEGSSDGGTSSSMPFSWQ

SEQ ID NO: 447 - protein, 431 aa, Zea mays
MDWDLNAAGAWDLAELEQDHAAAAPSSGGHAANAAAAGTGTESRPPAPGAAGAPAECSVDLKLGGMGECEPGAARREREAAAGAAKRPRPAGPGGQQQQQCPSCAVDGCRADLGKCRDYHRRHKVCEAHSKTPVVVVAGREMRFCQQCSRFHLLAEFDADKRSCRKRLDGHNRRRRKPQPDTMASASFIASQQGTRFSPFAHPRLEASWPPGVMKTEESPYHITHQIPLGSSSSSRQQHFVALGAATPAYAKEGRRFPFLQEGEISFATGVVLEPPAAAPACQPLLRTGAPSESSGAGGSKMFSDQGLARVLDSDCALSLLSAPANSSGIDVSRMVRPTEHVPMAQQPVVPGLQFGSASWFPRPQASTGGSFVPFCPAAVEGEQQLNAVLGPNDSEVSMNYGGMFHVGGGSGGGEGSSDGGTSSSMPFSWQ

SEQ ID NO: 448 - protein, 432 aa, Zea mays; identical to SEQ ID NO: 446

SEQ ID NO: 449 - protein, 267 aa, Zea mays; identical to SEQ ID NO: 382

SEQ ID NO: 450 - protein, 403 aa, Zea mays; identical to SEQ ID NO: 376

SEQ ID NO: 451 - protein, 325 aa, Zea mays
MDWAAASGSPSWGAAATDPGPTMLSFAGPSSSAADAEVRLQDFAAGLAQSSRPTGAAPGAGRRSRAAVGGAGAEACSVDGCRSDLSRCREYHRRHKVCEAHSKAPVVVVGGQERRFCQQCSRFHMLSEFDEEKRSCRKRLDGHNRRRRKPQHDLTNLGGFFPYHQVNQFEFYPQTIPTVGQNSDAVHLVGRQQPFSISFSRTPDEFPFPQGGGSSVLHHLHAARPGHHAEGSSHTGSSTRDNALSGTLGPECALSLLSSSLRRPSTAGVPAVGQPQVTASSTTAVSQAATAAVATAAFAASAGHHVFVPDAMFEDPSQALPFSWQ

SEQ ID NO: 452 - protein, 429 aa, Zea mays
MDWDLKMPVSWDLPDLEHDAMPPPPPVSAASTAAASGIAAAAAAPSSATAPSRAECSVDLKLGGLGEFGAADGTATKEPAAATAAPSASPMKRPRLGPGGAGGAQCPSCAVDGCKADLSKCRDYHRRHKVCEAHSKTPVVVVAGREMRFCQQCSRFHLLLEFDEAKRSCRKRLDGHNRRRRKPQPDTMNSGSFMTSQQGLFSSAGTRFSSFPAPRPEPSWSGVIKSEDSSYYTHHPVLSNRPHVAGTSTSPAYSKEGRRFPFLQDGDQVSFSASGAGTLEVSTVCQPLLKTTAAVAPPPPESSKMLAPVLDSDCALSLLSSPANSSSVDVSRMVQPAERIPMAQPLVPGLQHHQFGGSPVPDWFAGSGAVPAAGTGGFACPHSVESEQFNTVLVPSSDGGHEMNYHGIFHVGGEGSSDGTPPSLPFSWQ

SEQ ID NO: 453 - protein, 294 aa, Zea mays
MAASPDHLFGLRNSFYVGAYHAVITSSQSLPAHALSPDDLVERDALMYRSYIAIGSYQLVIGEIGPSAATPLQAVKLLAVYLSGDGGNRESVVSRLRELLSDAAVGSNPILRVMAGTVFMHERDYAEALKHTNSGGSMELLALNVQIYLQMNRTDHAEKQLRVMQQLDEDHTLTQLANAWVDLVLGGSKIQEARLIFQDLSEKYPTTCTILNGKALCSMHMGNFEDAEGLLLESLNKDAKDTETLANLTVCSLNLGKPATRYLNQLKLAHPDHALVKRMSSAAESFDRACQAMA

SEQ ID NO: 454 - protein, 505 aa, Zea mays
MAIPLPCKALPRHDGTKGSGQAYDGDDQPSVAAELRALWGMAAPVTALNCVVYLRAMVSVLCLGRLGPLDLAGGALAIGLTNITGHSVLFGLASGLEPLCAQAFGSRNHELLTLSLQRAVLLLLLAALPIALLWLNVGPILVALGQDPTISAHAASYAAFALPDLAAGAVLQPLRVYLRSQGITRPMAACSAAAVALHVPLNVGLVFGLGLGVRGVAAAQALTNANMLLFLLAYVRWARACEHTWKGWARPADVAAGLPALAGLAVPSCVGVCLEWWWYEVVTVLAGYLPNPAAAVGAAGVLIQTTSLMYTVPMALAASVSTRVGNELGAGKPRRARMAALVALWCALAVGVLHVAWTVALSRRWVELFTADPGVVRLASAAMPVVGLCELGNCPQTAGCGVLRGTARPAVGARINLLSFYLVGTPVAVYLAFGARAGFRGLWYGLLSAQATCVALVLVAVVWRTDWRVEAMRAKKLAGLELTNDAEEESRRLVAATGEQAEDTS

SEQ ID NO: 455 - protein, 584 aa, Zea mays
MGGGGGGVAKMPAGQLWLLLLGVLLLAFGVPAQASRNTHYDFVITETKVTRLCHEKTILAVNGQFPGPTIYARKDDVVIVNVYNQGYKNITLHWHGVDQPRNPWSDGPEYITQCPIQPGANFTYKIIFTEEEGTLWWHAHSEFDRATVHGAIVIHPKRGTVYPYPKPHKEMPIILGEWWNADVEQILLESQRTGGDVNISDANTINGQPGDFAPCSKEDTFKMSVEHGKTYLLRVINAGLTNEMFFAVAGHRLTVVGTDGRYLRPFTVDYILISPGQTMNMLLEANCATDGSANSRYYMAARPFFTNTAVNVDDKNTTAIVEYTDAPPSASAGPPDSPDLPAMDDIAAATAYTAQLRSLVTKEHPIDVPMEVDEHMLVTISVNTIPCEPNKTCAGPGNNRLAASLNNVSFMNPTIDILDAYYDSISGVYEPDFPNKPPFFFNFTAPNPPQDLWFTKRGTKVKVVEYGTILEVVFQDTAILGAESHPMHLHGFSFYVVGRGFGNFDKDKDPATYNLVDPPYQNTVSVPTGGWAAMRFRAANPGVWFMHCHFDRHTVWGMDTVFIVKNGKGPDAQMMPRPPNMPKC

SEQ ID NO: 456 - protein, 588 aa, Zea mays
MGARRGLRRGQAAAAAFSACPFLALAVVLLALPELAAGDTHYYTFNVQMTNVTRLCVTKSIPTVNGEFPGPKLVVREGDRLVVKVHNHINYNVSFHWHGVRQLRNGWADGPSYITQCPIQGGQSYVYDFTVTGQRGTLWWHAHFSWLRVHLYGPLVILPKRGEGYPFPRPYKEVPILFGEWFNADTEAVINQALQTGAGPNVSDAYTFNGLPGPTYNCSSKDTYKLKVKAREGRTCSRLHQLRPQTNELFFGIANHTLTVVEADASYVKPFTVSTLVISPGQTMNVLLTTAPSPASPAYAMAIAPYTNTQGTFDNTTAAAVLEYAPTPPPVATRNNTLPPLPALPLYNDTGAVSNFSRNFRSLNSARYPARVPAAVDRHLLFTVGLGTDPCPYTNQTCQGPNGTKFAASVNNNSFFRPRTALLEAHYRRRYAGVLLGDFPTAPPHPFNYTGTPPNNTFVQHGTRVVPLRFNASVELVLQGTSIQGAESHPLHLHGYNFFVVGQGFGNFDPVNDPPGYNLADPVERNTISVPTAGWVAVRFLADNPGVWLMHCHFDVHLSWGLSMAWLVNDGPLPNEKMLPPPSDLPKC

SEQ ID NO: 457 - protein, 225 aa, Zea mays
  misc_feature (181)..(181): Xaa can be any naturally occurring amino acid
MDAAGARPSAPSAAAAAVAGASVADEPRDARVVRELLRSMGLGEGEYEPRVVHQFLDLAYRYVGDVLGDAQVYADHAGKAQIDADDVRLAIQAKVNFSFSQPPPREVLLELARSRNRMPLPKSIAPPGSIPLPPEQDTLLAQNYQLLPPLKPPPQYEENEDENEESNPSLTPNPANSNPTXSQDQRSNEQQHTPQHGQRVSFQLNAVAAAAAKRPRMTVDQLNIG

SEQ ID NO: 458 - protein, 58 aa, Zea mays
MDTSLVQQWPLLTSALAWVCMTREMSPPSSFPRAWIEGSSSLSVCLSLSLPFLPVAVY

SEQ ID NO: 459 - protein, 559 aa, Zea mays
MYRVKSEGEGEGEGDCEMMLQEQMDSLVADDVSSGGGSPHRGVGTPLKKGPWTSAEDAILVDYVKKNGEGNWNAVQKNTGLFRCGKSCRLRWANHLRPNLKKGAFTPEEERLIIQLHAKMGNKWARMAGHLPGRTDNEIKNYWNTRIKRCQRASLPIYPASVCNQSTNEDQQLSGNFNGGENISNDLLSGNSLYLPDFTSDNFIANPEALSYAPQLSAVSISNLLGQSFASKSCSFMDQVDQAGMLKQSGCVLPALSDAIDSVLSSADHFSNDSEKLRQALGFDYLNEANASSKSIAPFGVALTGSHAFLNGNFSASRPTNGPLKMELPSLQDTESDPNSWLKYTVAPAMQPTELVDPYLQSPSATPSVKSECASPRNSGLLEELLHEAQALRSGKNQQSSVRSSSSSAGTPYETTTVVSPEFDMGQEYWEEQPSSFLSEYAHFSGNSFTESTPPVSAASPDIFQLSKISPAQSPSMGSGEQALEPKHESAASPRPENLRPDALFSGNTADPSIFNNAIAMLLGNGIDAEYKPVLGDGIVLDSSSWNNMQHAFQMAGFK

SEQ ID NO: 460 - protein, 362 aa, Zea mays
MEKSPGAAPTSSPEEEVAADGRGHVEDATGQKEQATPVVLKKGPWTAAEDAMLMDHVRHHGEGNWNAVQRVTGLLRCGKSCRLRWTNHLRPNLKKGSFSPDEELLIAQLHAQLGNKWARMAAHLPGRTDNEIKNYWNTRTKRRQRAGLPVHPPPEVQLQLALARRCRYDDFSPLPSPQELSGVQALVGAAASAGYASSRPAPLDLARQLTQTTNQQTETVQFLSPPPFSAPSSPWARPFARNAQYFQLAHSSSPVSPTTPDLSLGYGARSAGADQSRLPPLSPSPCPRVVELPSNQYAQPTPPASAAATALGGGGAALPDHQNAASLEKMLRELHDVIKVDPPALVPASGGAALEWHGGGGE

SEQ ID NO: 461 - protein, 362 aa, Zea mays; identical to SEQ ID NO: 460

SEQ ID NO: 462 - protein, 362 aa, Zea mays; identical to SEQ ID NO: 460

SEQ ID NO: 463 - protein, 362 aa, Zea mays; identical to SEQ ID NO: 460

SEQ ID NO: 464 - protein, 362 aa, Zea mays; identical to SEQ ID NO: 460

SEQ ID NO: 465 - protein, 418 aa, Zea mays
MAFISSAAMKAAVAALLVFAAVSPAARAVAAEAEAKAKAVGGAPSVPAGSLDIAQLGAKGDGKSDSTPMVLKAWKHACEATGQQKIVIPKGNYLTGALDLVGPCKSSIIIRLDGNLLGTGDLNAYKRNWIEIQNVDNLSINGHGTIDGQGALVWNKNECQRSYNCKILPNSLVLDFVTNAQIRGITLLNSKFFHMNIFGSKNVVIDKVTIKAPGNSPNTDGIHIGDSSNVTISGTTIAVGDDCVSIGPGSKTIRVKGVKCGPGHGISVGSLGRYKDEKDVEDVKVTGCTLAGTTNGLRIKSYEDSKSSLKATKFLYQDVTMDNVSYPIIIDQKYCPNNICVKSGASKVAVNDVVFKNIHGTSNTPEAITLNCANNLPCQGVQLINVDIKYNRSDNKTMSVCKNAIGKSIGMAKELACV

SEQ ID NO: 466 - protein, 454 aa, Zea mays
MSSFRPAPSALSMGLESNRSLEDLVCTGQGSSNVGLLSSLSPGGQLGRSTVMESFSSGLPTSFNQGIINAGGSITNITSSNINNVRSNFPLMASPSNFSDAYRARSVSEDKSGKVVGSGGPRNELVPYHRNKGAETRSHGQGQQTLFLKRAASRRCAGSSGTVSPVSKSPPRVVTSASNDSSVDTPDKDSPHPRNAHLQSASGRLNINSGSDDPNDMGLDGDDYDAKDDDDLDESGDGSGGPYEVEEGAGNGADQSIGKGNGKGKRGLPAKNLMAERRRRKKLNDRLYTLRSVVPKITKMDRASILGDAIEYLKELLQRINEIHNELEAAKLEQSRSMPSSPTPRSTQGYPATVKEECPVLPNPESQPPRVEVRKREGQALNIHMFCARRPGLLLSTVKALDALGLDVQQAVISCFNGFALDLFRAEAKDVDVGPEEIKAVLLLTAGCDLHSLQ

SEQ ID NO: 467 - protein, 842 aa, Zea mays
MGTMVAAVALRGGSSDSGGFDKVPGMDSGKYVRYTPEQVEVLERLYIDCPKPSSSRRQQLLRECPILSNIEPKQIKVWFQNRRCRDKQRKESSRLQAVNRKLTAMNKLLMEENERLQKQVSQLVHENAHMRQQLQNTSLANDTSCESNVTTPPNPIRDASNPSGLLAIAEETFTEFLSKATGTAIDWVQMPGMKPGPDSVGIVAISHGCRGVAARACGLVNLEPTKGIEILKDRPSWFRDCRSLEVFTRFPAGNGGTIELIYMQMYAPTTLVPARDFWTLRYTTTMEDGSLVVCERSLSGSGGGPNAASTQQFVRAEMLPSGYLVRPCEGGGSIVHIVDHLDLEAWSVPEVLRPLYESSRVVAQKMTTVALRHLRQIAQETSGEVVYALGRQPAVLRTFSQRLSRGFNDAISGFNDDGWSVMGGDGIEDVVIACNSTKKIRNTSNAGITFGAPGGIICAKASMLLQSVPPAVLVRFLREHRSEWADYNIDAYLASSLKTSACSLPGLRPMRFSEGQMIMPLAHTVENEEILEVVRLEGQPLTHDEALLSRDIHLLQLCTGIDEKSVGSSFQLVFAPIDEHFPDDAPLISSGFRVIPLDVKTDGVSSGRTLDLASSLDVGSAAPQASGESPDDCSLRSVLTIAFQFPYEMHLQDSVAAMARQYVRSVISAVQRVSMAISPSQSGLNAGHRMLSGFPEAATLARWVCQSYHYHLGMELLNQSDGAGEALLKMLWHHPDAVLCCSFKEKPMFTFANKAGLDMLETSLVALQDLTLDKIFDESGRKALFSDISKLMEQGYAYLPSGVCMSGMGRHVSFDQAVAWKVLGEDSNIHCLAFCFVNWSFV

SEQ ID NO: 468 - protein, 840 aa, Zea mays
MAAAVAMRGGSSDSGGFDKVPGMDSGKYVRYTPEQVEVLERLYIDCPKPSSSRRQQLLRECPILSNIEPKQIKVWFQNRRCRDKQRKESSRLQAVNRRLTAMNKLLMEENERLQKQVSQLVHENAHMRQQLQNTSLANDTSCESNVTAPPNAIRDASNPSGLLAIAEETFTEFLSKATGTAIDWVQMPGMKPGPDSVGIVAISHGCRGVAARACGLVNLEPTKVIEILKDRPSWFRDCRSLEVFTMFPAGNGGTIELIYMQMYAPTTLVPARDFWTLRYTTTMEDGSLVVCERSLTGSGGGPNAASAQQFVRAEMLPSGYLVRPCEGGGSIVHIVDHLDLEAWSVPEVLRPLYESSRVVAQKMTTVALRHLRQIAQETSGEVVYALGRQPAVLRTFSQRLSRGFNDAISGFNDDGWSVMGGDGIEDVVVACNSTKKIRNNSNAGITFGAPGGIICAKASMLLQSVPPAVLVRFLREHRSEWADYNIDAYLASSLKTSACSLPGLRPMRFSGGQMIMPLAHTVENEEILEVVRLEGQPLTHDEALLSRDIHLLQLCTGIDEKSVGSSFQLVFAPIDEHFPDDAPLISSGFRVIPLDMKTDGVSSGRTLDLASSLDVGSAAPQASGDAPPDDCNLRSVLTIAFQFPYEMHLQDSVATMARQYVRSVVSAVQRVSMAISPSQSGLNAGQRMLSGFPEAATLARWVCQSYHYHLGVELLNQSDEAGEALLKMLWHHPDAVLCCSFKEKPMFTFANKAGLDMLETSLIALQDLTLDKIFDESGRKAIFSDISKLMEQGYAYLPSGVCMSGMGRHVSFDQAVAWKVLGEDSSVHCLAFCFVNWSFV

SEQ ID NO: 469 - protein, 854 aa, Zea mays
MAAVASRERLSPGAAPQVDAGKYVRYTPEQVEALERVYSECPKPSSLRRQHLIRDCPILRNIEPKQIKVWFQNRRCREKQRKESSRLQTVNRKLSAMNKLLMEENDRLQKQVSRLVFDNGYMKNRLHSPSVATTDTSCESVVTSGQHNQQQNPAVLHPPQRDANNPAGLLAIAEETLAEFMSKATGTAVNWVQMVGMKPGPDSVGIIAVSHNCSGVAARACGLVSLEPTKVAEILKDRASWYRDCRHVDVLHVIPTGNGGTIELIYMQTYALTTLAEPRDFWTLRYTSGLDDGSLVICERSLTQSTGGPSGPNTPNFIRAEVLPSGYLIRPCDGGGSMIYIVDHVNLNACSVPEVLRPLYESPKILAQKMTAAALRHIRQIAHESSGEMPYGAGRQPAVLRTFSQRLSRGFNDAVSGFPDDGWSCLLNTDGAEDITVTINSSPNKLVGSHVSASPLFSAMGGGIMCAKASMLLQNVPPALLVRFLREHRSEWADPGIDAYSVASLRANPYTVPGLRAGGFMGNQVILPLARTLEHEESLEVIRLEGHGFSHEEVLMSRDMFLLQLCSGVDEDAPGACAQLVFAPIDESFADDAPLLPSGFRVIPLDAKTDVPTATTRTLDLASALEVGSGGSGMRASCDGSGTCATRSVLTIAFQFSFENHLRESVAAMAKQYVRGVMASVQRVAMAIAPSRLGSRIELKHPPGSPEALALATWIGRSYRAHTGTEIRWSDTEGADSPLMLFWKHSDAILCCSLKPPAFTLKFANSAGFDILETTMVNIQDLPLEAVLDEEGQKALSAQLPAIMQQGLAYLPGGVCRSSMGRQASYEQAVAWKVVGDDGAPQCLALMLANWTFI

SEQ ID NO: 470 - protein, 854 aa, Zea mays
MASSRGRLRLSPRAAAPQLDAGKYVRYTAEQVDALELAYGECPKPSSLRRQQLIRDCAVLTNVEPRQIKVWFQNRRCREKQRRESSRLQTVNRKLGAMNKLLMEENDRLQKQVSRLVFDNGYMKNRLHSPSVATTDTSCESVVTSGQHKQQQNPAVLHPPQRDANNPAGLLAIAEETLAEFMSKATGTAVNWVQMVGMKPGPDSVGIIAVSHNCSGVAARACGLVSLEPTKVAEILKDRASWYRDCRRVDILHVIPTGNGGTIELIYMQTYALTTLAEPRDFWTLRYTSGLDDGSLVICERSLTHSTGGPSGPKTPDFIRAEVLPSGYLIRPCDGGGSMIYIVDHVDLNACSVPEVLRPLYESPKILAQKMTAAALRHIRQIAHESSGETPYGAGRQPAVLRTFSQRLSRGFNDAVSGFPDDGWSSLLSSDGAEDISITINSSPNKLIGSDVSPSPFFSAMGGGIMCAKASMLLQNVPPALLVRFLREHRSEWADPGVDAYSAASLRANPYNVPGLRAGGFMGNQVILPLARTVEHEECLEVIRLQGHGFSHDEVLMSPDMFLLQLCSGIDEDAPGACAQLVFAPIDESFADDAPLLPSGFRVIPLDAKTDVPSATRTLDLASALEVGSGGGLCALSDSGSGTRSTRSVLTIAFQFSFENHLRESVAAMARQYVRAVMAIVQRVAMAISPSRLGPHVELKHPPGSPEALALASWIGRSYRAHTGTEIRWSDTEDAAGSPLTLFWKHSDAIICCSLKPAFTLKFANSAGFDILETTVANVQDLQLEAVLDDGGQKALVAQLPKIMLQGLAYLPGGVCRSSMGRQASYEQAVAWKVVGDDGAPQCLALMFVNWTFI

SEQ ID NO: 471 - protein, 854 aa, Zea mays; identical to SEQ ID NO: 470

SEQ ID NO: 472 - protein, 192 aa, Zea mays
MSSAPLQIAPVPEHVCYVHCNFCNTILAVSVPSHSMLNIVTVRCGHCTSLLSVNLRGLIQSLPVQNHHYSQQQENFTVQNMGFTENYPEYAPSYRMPTTLSAKGDLDHMLHVRAPEKRQRVPSAYNRFIKEEIRRIKACNPDISHREAFSTAAKNWAHFPNIHFGLGPCESSNNLDEATGAMCHPQKVQDLY

SEQ ID NO: 473 - protein, 179 aa, Zea mays
MSSAPLQIAPVPEHVCYVHCNFCNTILAVSVPSHSMLNIVTVRCGHCTSLLSVNLRGLIQSLPVQNHHYSQQQENFTVQNMGFTENYPEYAPSYRMPTTLSAKGDLDHMLHVRGSNDCGFFVMSYMKSYDHNAGVISSFNQPDNSRDLRAHALHQLTFHRINKVLPLPLDIQRFMFARN

SEQ ID NO: 474 - DNA, 729 bp, Sorghum bicolor
gcatctgaagtgctaatccaatgctgaagtggtgaaagaaagaatttagaacatctggacaacacatgtttgggttccagtgtccaattagtcagaaaatggagtcgctctacacctagcagtctagggcagtggctattgtacatagttacatattgggagcaatgcaaccctgtccggggacacaaaaaaaaagaagaaatacattcatgagcaatcagagaaacaaaacatgaaacgcctccagccatccaatatttacaatcacttgcggagtccaggatcaagtgtcttgatactctggtctatatgccggataatgcaaacagaaacagcagcaaatagcttgcggctctcgcaccacaactgcagacttcttccaaatgcttcaacaattggtgggcaggcaggcagacgggttggaaacaatcagatcactgcaaaaacattatctggaaaggagtgattgtccctggcgcttggtcagtaacaacatgtaagccttcctcaacagcacgtttacagaattgcaggaggtccggccatctggtcctctcttttttttccctgggtatggtagactagcttcatggctcttgcttcgtatgatgagaaatgcttgccgtaccatatgatgcaaccagtctgttcagttgaataagtgaatttatatggtcttcatttatggataaaggcaatggaggcatctgacccatgataccaggcgtt

SEQ ID NO: 475 - DNA, 756 bp, Sorghum bicolor
gcctactgatggcgtctctctgcctcgtcagtcgtcactgagcaccggcgccgcgccccccacctccactccacctgcacaccgccgtccccccaccctcacccccacgcagccatccgctcctcgtcgccttccgacgccgagttcgccggtgtcgatttgcgccggcggcggctcgatctggccgccgcccgtgccgacctgctcgtcgaatccgttttcagacgtaatggatgggcaaggcacaaagcacaggattttgatggtgtctgactttttctttccaaactttggtggggtggaaagccatatctactacctgtcacaatgtctacttaagcttggccataaggtggttgtcatgacgcatgcatacggaaacagatctggagtacgatatgttacaaatggtttaaaggtttattatgtaccatggaggccattcctgatgcagaatacacttcctacattattcttgacgttcccaattgtaaggacaattattattcgagagaagatttctgtcgtgcatggacatcaagctttttcaacactgtgtcatgaagcattaatgcatgctaggacgatgggtttactcttgcagatattgatcaggcaatatgtgtctctcatacaagcaaagagaatactgtcttgaggtctgggatatctccagagaaggttttcatggttcctaatgcagttgatactgcaatgtttactccctcccccaagcgcttaagctgtgatgaaata

SEQ ID NO: 476 - DNA, 2186 bp, Sorghum bicolor
atggatgggcaaggcacaaagcacaggattttgatggtgtctgactttttctttccaaactttggtggggtggaaagccatatctactacctgtcacaatgtctacttaagcttggccataaggtggttgtcatgacgcatgcatacggaaacagatctggagtacgatatgttacaaatggtttaaaggtttattatgtaccatggaggccattcctgatgcagaatacacttcctacattattcttgacgttcccaattgtaaggacaattattattcgagagaagatttctgtcgtgcatggacatcaagctttttcaacactgtgtcatgaagcattaatgcatgctaggacgatggggtacaaagttgtcttcacagatcactcactttatggttttgctgatgctggaagcattcacatgaataaggtgctgcagtttactcttgcagatattgatcaggcaatatgtgtctctcatacaagcaaagagaatactgtcttgaggtctgggatatctccagagaaggttttcatggttcctaatgcagttgatactgcaatgtttactccctcccccaagcgcttaagctgtgatgaaatagttattgttgtgatcagtagattagtataccgaaaaggtgctgaccttcttgttgaagtcattccagaagtgtgtcgtctatttccaaaggttcgctttattgttggtggtgatggtccaaaacgtgtgcgccttgaagaaatgagggagaagttctcccttcaggatagagttgagatgttaggagctgtacctcatgctcaggtgcgatctgttctgatatctggacatatatttttgaacagttcacttacagaggcattttgcatagctattctagaagcagcaagctgtggactgttgacagtgagtactagagtcggtggtgtccctgaggttcttccagatgacatgatagtacttgcagaaccagctcctggagatatggtaagagctgtcaagaaagccatcgacatgctacctggcatagacccccaaatcatgcatcttcggatgaaaaaactttatagttgggatgatgtggccaaaagaactgagattgtttatgaccgtgcaatgcagttcccaacaacaaatttactagatcgccttccccgatatcttacttgtggatcttgggctggaaaactgttttgcctagttatgatcatcaattacctactatggcgccttttagagttcctacagcctgctgaaggtattgaagaagtcccagatatagggccactacatgctcatttaggttcaaagaatgatttttgtgaggctcaagagaagtgaaacttacattttgtcagttttgaaatggttggggacttgaggtggcaatcatggtatcttctgcttgtcagcatccgttctgatccacaaacccggtatactttatgatatggttcccacacagcattttatcttgaagcttcctgtttcagtagtgggaactgacagagagagcagcgatcttgatttggaggatttcttgtcatgctggttaaagctatggtccaagtctctgtcattgccaactcgtttcttttagcctagtgagttaatgatccgcgttcttatctccggaccattattcaacaaagtatccgctagaacaatggtactctgatactctcttttgccaccagattgcagtgtttttttagccacatctcggttttgactcgtactgtttcatgattctcacagaaaaacattaggatatcacagtatccagagtcttgattgacatctcgtgtcataacaccttgtgatgtcttatatcatgttggagcaccgattcctactatgttggtgatgtaaggccaattccaaccagcgacttgtgtgaatccaatatgcatggttccagttgataatgtattgagtatataaaaaaattgcaatccctttcggcacccttcagaattaaagaatttgatcattcgctttgtaagttagcttttgtaagatatgagttttttctcagggactattcaatccgtatggaatgttttgcgaaatttttgttttacgagtgggtacatgaacttgtgtccatttggaatatctgtgtacctccattcgatggcctgttttccccagtttaatttaatttaaaaatgcagctt

SEQ ID NO: 477 - DNA, 1084 bp, Sorghum bicolor
cacacacgaacacattattcctccatctcctcgatcgcctggccatggcaatctcctctgctcttccctgctccctcctcatggcggccctgatgctcctcgcctctgccgtcgaagtgcaaggcatcacgaggcactacgacttcaatgtgacaatggcgaacgtgacacggctgtgcgccagcaagagcatcatcacggtgaacgggcagttccccggccccaagatcgtcgcgagggaaggcgaccgcctcgtcatccgcgtgaccaaccacgcccagcacaacatctcgctgcactggcacggcatccggcagctgcgcacggggtgggcggacgggccggcgtacatcacgcagtgcccgatccagacggggcagagctacgtgtacaactacaccatcgtcgggcagcgcggcacgctgtggtggcacgcgcacatctcctggctgcgcgccaccgtctacgggcccctcgtcgtcctgcccaagctcggcgtcccctacccgttcccggcgccgtacaaggaggtccccgtcatcttcggtgagtggtggctggcggacacggaggtggtgatccagcaggcgcttcagctcggcgctggtccgaatgtctctgacgcccacaccatcaacggcctaccaggaccgctctacaactgctctgccaaagacacgttcaagctgaaggtgaagccagggaagacgtacatgctccgcctcatcaacgcggcgctcaacgacgagctctttttctccatcgccaaccactcgctcaccgtcgttgaggtcgacgccgtctacgtcaagcccttcaccgtcgacaccctggtgatcgccccgggccagaccaccaacgtgctcctcgccgcgaagccgttctacccggccgccaactactacatgaccgccaggacctactccaccggccggccggccaccttcgacaacaccaccgtcgccggcatcctcgagtacgagtaccccgacgcgccctccgccgcggcgagcttcaacaaggccctgccgctctacaggccggcgctgccgcagctcaacgacaccagcttcgtcggcaactt

SEQ ID NO: 478 - DNA, 489 bp, Sorghum bicolor
tctggaacgcacacacacaaacacattattcctccatctcctcgatcgcctggccggccgtcttggttgccctctagagctcgagagcaactcaagatatagctagctagctgctcatcggagtctagctagaggtttaaccatcagctagctagctggccatggcaatctcctctgctcttccctgctccctcctcatggcggccctgatgctcctcgcctctgccgtcgaagtgcaaggcatcacgaggcactacggcttcaatgtgacaatggcgaacgtgacacggctgtgcgccagcaagagcatcatcacggtgaacgggcagttccccggccccaagatcgtcgcgagggaaggcgaccgcctcatcaacgcggcgctcaacgacgagctctttttctccatcgccaaccactcgctcaccgtcgttgaggtcgacgccgtctacgtcaagcccttcaccgtcgacaccctggtgatcgccc

SEQ ID NO: 479 - DNA, 2265 bp, Sorghum bicolor
ctcagacgcagtgttccattccaacatttagctagccaacaaggatcatcggagctcgggctcaagtacttgttcttagctgacttcttcattgtaggaaacaatggctacctcctatctgctgccttgctatgtcctcatcactgtgctcgtgctcttcttctccgtcgacgttacggaaggggccatcagggagtaccagttcgatgtgcaaatgacgaatgtgacgcggctgtgcagcagcaagagcatcgtgacggtgaacggtcagttcccggggccgccggtgttcgctagggagggcgacttcgtcgtcatccgcgtcgtcaaccacgtcccctacaacatgagcatccactggcacggcgtccggcagctgcggagcgggtgggcggacgggccggcgtacatcacgcaatgcccgatccagagcgggcagagctacgtgtacaagttcaccatcacggggcagcgcggcacgctgtggtggcacgcgcacatctcctggctgcgcgccaccgtctacggcgccatcgtcatcctgcccaagcccggcgtcccttacccgttcccggcgccctacaaggaggtccccgtcatcttcggcgagtggtggacggcggacacggaggcggtgatcagccaggcgctccagaccggcggaggacccaacgtctccgacgccttcaccatcaacgggctgcctggcccgctctacaactgctctgcaaaagacacgttcaagctgaaggtgaagcccgggaagacgtacatgctccgcatcatcaacgctgcgctcaatgacgagctcttcttctccatcgccggccacccactcaccgtcgtcgacgtcgacgcggtctacatcaagcccatcaccgtcgacaccatcctcatcacccccgggcagaccaccaacgtgctcctcaccaccaagccgtcctaccccggcgccacctactacatgctggccgcgccctactccaccgccaggccgggcaccttcgacaacaccaccgtggccggcatcctcgagtacgaggaccccacgtcccctcccccgcacgcggccttcaacaagaacctcccggcgctgaagccgacgctgccgcagatcaacgacacgagcttcgtcgccaactacacggccaagctccgcagcctcgccaccgcggagtaccccgccgccgtgccgcaggaggtggaccggcggttcttcttcacggtcgggctgggcacgcacccgtgcgccgtgaacgggacgtgccagggccccaccaacagcagccggttcgcggcgtccgtgaacaacgtctccttcgtgctcccgacgacggcgctgctgcagtcgcacttcgccggaaagtccaagggggtgtactcgtccaacttccccgccgcgccgctcgtcccgttcaactacacggggacgccgcccaacaacaccaacgtggccaacggcaccaagctggtggtgctgccgtacggcgccagcgtggagctggtgttgcagggcaccagcatcctcggcgccgagagccacccgctgcacctccacggcttcaacttcttcgtggtcggccaagggttcggcaacttcgaccccgccaaggacccggccaagtacaacctcgtcgaccccgtcgagcggaacaccgtcggcgtgccggcggccggctgggtggccatccggttccgcgcagacaatccaggggtatggtttatgcattgccacttggaggttcacgtcagctggggcctgaaaatggcatggctggtgctggacggagaccgccccaacgagaagctgctgcctccgccgtctgatctccccaggtgctgaggcagacgacacgaggaattgctgcccggcctgcaggtcgccatcaacggccgtgatcgattgggcccggccggccgtcttggaacagggattgcgtgctctctaatttgcataggatatcttaatcatcttttggttgtgctggggttggtgttatgcgatgctttcattaatagaggtgtgcttttccgggttgagtcgtcgtctggttagctgtgtgagtgagagtcacacgggcaggaaggttcataccacttactcagtataaggcaaacgccatgtattttttgattgtttatgagttactgtactaccatcttttgtaaatcagattcttgtcgtcggggaactggatagtgtatccaggcgtgcctcccaaataatatgtttacgactatcagcattgttggaatttatttttg

SEQ ID NO: 480 - DNA, 2029 bp, Sorghum bicolor
cttcctcccgtgtcccgtcgaaccagccgagcaagccaacgcaacgcaacgcaaacccagcgagccgcggcgcctcgtcgcgcgcgccttgcctgtctgtccgcttcttcgtccgatcgcccgcgtcgtccgccggtccgagagcccctccccacccgaaggatggcggagcccgcggcgacgccgacgacggcggcggggaggaagacgcgggtgggcccgtacgaggtcggcaagaccatcggggagggcagcttcgcaaaggtgaagcacgcccgcgactcccgcaccggcgccgtccgcgccatcaaggtgctcgaccgcaaccacgtcctccgacacaagatggtcgagcagatcaaacgggagatttcgactatgaagctaatcaaacatcccaatgtggtccagctgcatgaggttatggcgagtagaacaaagatatatatggttcttgaatttgtggatggaggcgagttattcgataagatcgtcaattctggaaggctaggagaggatgaagctaggatatactttcatcaacttataaatgcggttgattattgccatagccgaggagtgtaccatagagatctgaagccagagaatctgcttctggactcacatggaactcttaaagtttcagacttcggcctaagtgcatttgcaccacaaacaaaagaggatggacttctgcatactgcctgtggaactccaaactatgtagcacctgaggttcttgctgataaaggttatgatggtatggctgcagacgtatggtcctgtggcataatcttatttgttcttatggctggatacttaccctttgatgacgccaatctgatgagactgtacaagctgatctgccaagcgcatgtttcttgcccaccatggttttcttctggagcgaagaagtttattaagcgcattctcgatcctaatcctgatacgaggataacaattgcagaaattttgaaagatgaatggttcaaaaaagactataaaccaccacgttttgaacaaggcgaagatgttagccttgacgatgtcgatgctgcattcaatgattcagaggaccgccttgtgtcagagaacagagaaaaaccagaatccatgaatgcatttgctcttatttcgagatcacagggcttcaaccttggaaatttgtttgagaaggagatgatgggaatggtaaagagggaaacatctttcacgtctcaatgtacagcacaggagatcatgacaaaaatagaggatgcatgtgggccacttggtttcaacgtgcggaaacaaaattacaagatgaaattgaaaggtgacaaatctggaagaaaaggtcacttatctgttgcaactgaggtttttgaggttgctccatcacttcacatggttgagcttcgtaaaaccggtggagacacattggagttccacaatttctacaagaacttctcaacagagctgaaagatatcgtgtggaaagctgaatctgacgcaactaagaaatagacgaagtgatacccaggaaattgtgtaccttatgaggccacattgagataaaccaccacttcgggtgataccgcttgcttggtactgtatgtttttttttactggtaccacattagctgtcaaattctctcgtaattcgtaaaccagagctccttctgaatgagcgcagttgtacacaatacatatgaagaggccctccctgagatgctccaaacacagcaatgggatgtcaaaatagctattctgaatgctttggttgtcccggggttgagtgcctttcttttatgaaaatagcgaatggtttatgatggtatgaagctaaactctagtatttttgagcaactgaacggttattcaggtggtgtttgggattgttccgctccacattttttagctttgcttcttgtttttttagctaaacggttttagcttcatgtactctgcttgagaaaaaagtatggagttatgaaagtacttaaaaaggtgcttcacaaaattctgattttttgtgaagttgcgctac

SEQ ID NO: 481 - DNA, 2260 bp, Sorghum bicolor
accaatcaccaaatcatcgcagcacaacagaacaagcacagaattcgtttgtcaaagggcctacctctagctaaagagaaatggcgtcctcgtctgctctccgttccagcgcctctgtcgtcgtcgtcgtcgtcgtggcagtggtgctgctcgccgccatgggagccgaggccgagacaagaaagtaccagttcgatgtgcaaatgaccagcgtgacgcggctgtgcggcacgaagggcatcgtgacagtgaacggacagtacccaggtcccacgctgttcgcgcgggagggcgaccacgtggaggtcaacgtggtcaaccgctccccctacaacatcagcatccactggcacggcgtgcggcagctgctgagcgggtgggcggacgggccctcgtacatcacgcagtgcccgatccagcccggccagagctacgtgtaccggtaccagatcgtcgggcagcgcggcacgctgtggtggcacgcgcacatctcctggctccgcgccaccgtctacgggcccatcgtcatcctgccccccgccggcgtgccgtacccgttcccggcgccggacgaggaggtgcccgtcatgttcggcgagtggtggaggaacgacacggaggcggtgatcgcgcaggcgctgcagaccggcggcggacccaacgtctccgacgcctacaccattaacggactcacggggcctctctacaactgctccgctcaagacacgttcaagctgaaggtgaagcccggcaagacgtacatgctccggctcatcaacgccgcactcaacgacgagctcttcttctccgtcgccaaccacacgctcaccgtcgtcgacgtcgacgcgctctacgtcaagcccttcaccgtggacaccctcatcatcgcgccggggcagaccagcaacgtcctgctcgccaccaagccgacgtaccccggcgcgatctactacatggaggcgcggccgtacaccaacacgcagggcacgttcgacaacaccaccgtcgccggcgtcctcgagtacgaggacccttcttcttcctcctcctccggcgagaaccagagcaacagcaacctcccggtcttcgcgccgaccctgccgccgatcaacgacaccagcttcgtggccaactacaccgcgaagctccgaagcctggcgagcgcggagtacccggccgccgtgccgcaggacgtcgaccggcggttcttcttcaccgtggggctcggcacgcacccgtgcgccggcggcgtcaacgggacctgccagggccccaacgggtcccggttcgcggcgtccatcaacaacgtctcgttcgtgctgcccacgacggcgctgctgcaggcgcacttcgccggcaggtccaacggcgtctacgccaccaacttcccggcgttcccgccgacgccgttcaactacgcgggcacgccgcccaacaacaccaacgtgatgaacgggacgaaggtggccgtgctgccgttcggcaccagcgtggagctggtgctgcaggacaccagcatcctcggcgcggagagccacccgctgcacctccacggcttcaacttcttcgtcgtcggccaggggttcggcaactttgacccgaccaatgatccggccaagttcaacctcgtcgaccccgtggagcgcaacaccgtcggcgtgcccgccggcggctgggtcgccatccgcttccgtgcggacaacccaggtgtgtggttcatgcattgtcacctggaggtgcacatgagctggggcctgaaaatggcatggctggtgctggacgggagcctgccgaaccagaagctgccgcctccgccattggatctgcctcagtgctaggcgcgcgtcagagactcaagaacaatggccaatgttggtttcctcgatcagttccactgcattattatattacccatcatcaatgcgcagcttcgtttgctcgatcagttgccgttttgcatggtattgtacctcgatttttctgcagcttacgtcgcgacaatttcttttcctagttggtgtgattctttttgttaatggattattcctgatttcccatcgtttctgttgtgcttcgttcggcggccatgtttcttgtaatctttcttgtagctcaaagcttgcctgtagctttttttgtgtgtgtgtgtgtgtgtgtgtgtgtgtgtgtgttatgggtgcaatgtaaccttgcgcttggcctggtatgactaataaaaagtgtaacgtgactgatttctctgaattaagatagagtttgt

SEQ ID NO: 482 - DNA, 1731 bp, Sorghum bicolor
atggcggcgccatcatctcttgcattcctcctgttctttggtacgttgctagcattgccgcagtcgtcgcacggcgcaaccagatactacaccttcaatgtgacgatgcagaaggtgacgcggctgtgcaccacccgcgccatcccgacggtaaacggcaagttcccggggcccaagatagtcaccagggagggcgatcgcgtcgtcgtcaaggtggtgaacaatgtcaaggacaacgttaccatccactggcacggcgttcggcagctgcggacggggtggtcggacgggccggcgtacgtgacgcagtgccccatccagacggggcagagcttcgtgtacaacttcaccatcacggggcagcgcggcaccctgttctggcacgcgcacgtctcctggttgcgcgccacgctctacgggcccatcgtcatcctccccaagcgcggcgtcccctacccgttcctcccggttaaaccctacaaggaggtccccatcatcttcggagagtggttcaacgcggatcccgaggcaattatcgcccaggcgcttcagactggagcaggcccaaatgtgtctgacgccttcaccatcaacgggcttccaggccccttgtacaactgctccagcaaagacacgttcaagctgaaggtgctccccggcaagtggtacctgctccggctcatcaacgccgcgctcaacgacgagctcttcttctccatcgccaaccacacgctcaccgtcgtcgacgtggacgcctcctacgtgaagccgttccacacggacatcgtcctcatcacgccgggccagaccaccaacgtgctcctgcgcgccgagcccgacgccgggtgcgccgcggccacgcacctcatgctggcgcgcccctacggcacgggccagccgggcaccttcgacaacaccaccgtcgccgccgtgctcgagtacgcgccggcggcggcggcggggcacatcaagagcctcccgctcttccggccctcgctccccgcgctcaacgacacggccttcgcggccaactacagcgccaggctccggagcctggccacaccggagttccccgccaccgtgccccgcgccgtggaccgctccttcttcttcgccgtggggctcggcaccaacccttgccctgccaaccagacgtgccagggccccaccaaccggaccaagttcacggcgtccatgaacaacgtgtccttcaccatgcccaccaccgcgctcctgcaggcgcactacgacaacatcgccggcgtgtacacggccgacttccccgtcgcgccgctggagccgttcaactacacgggcacgacgcccaacaacaccaacgtctccagcgggaccaaggtggtggtgctggagtacaataccagcgtggaggtggtgctgcagggcaccagcgtcctgggcgccgagagccacccgctgcacctccacggcttcgacttcttcgtcgtcggccaaggcttcggcaactacgactcgtcaaaggacccagccaagttcaatctagacgacccggtgcagaggaacaccgtcggcgtgccgtccggtggttgggtcgccatcaggttcttcgcggataatcccggtgtttggttcatgcattgccacttggaggttcacacaagctgggggttgaagatggcatgggttgtcaacgacggcccgttgcctgagcagaagctgatgccgccaccgcccgatcttcccaagtgttga

SEQ ID NO: 483 - DNA, 547 bp, Sorghum bicolor
cacatacagcattaccatatatatttcgttgggtaaactggtgaaagtcaatcatgttacatgtacaagaatttcgatctacttgtagtatgtatatatattgactgagaaggatctgaaacaaaaaaaccactcttatcatgcgacaaaatagagcacgccgtgccacttcgtcttgccagtaaatccaccctcactgcgatcgcatcctcgagacatcgctcccaccggccccggctccccgtcggccaacaaatacaatgcagcatgtcctggcagcggagctgaggccggatcgccggagggtagcaaggcggcaaggcaagcaactagaaggcggctgccctgtccttgacgacgacgtcctccacctccctcctcatgagcttctcctcctgctgcttccggcagaagaccacccacgcgttcacctccagcgcgacgcaggcgcccatcagcgtggcgagcgccaggcagtagccgagcttccagtaggatgcgccgagccccatgacctcgaagccctggaagacgttgaccaccccga

SEQ ID NO: 484 - DNA, 727 bp, Sorghum bicolor
tgtgtatgactgtgggaagagcttgaaccctgcgatagacttaggacagattgaaggttcctttatacagggaattggttttttcgtatatgaagagtatattacaaacagtgatggcctgatgattagcaacagcacatgggactacaagatcccaagtgtcgacataatcccaaagcagtttaatgctgaagtgctgaacactggataccataagaaccgtgtgctttcttccaaagctgctggtgaacctgccttggttcttgcctcatccgttcattgtgcactgagagaagctatccgagcagcaagaatggagtttgcaaacagcactgtatctggacgctcaccgctggaattcaagatggatgtcccagcaccaatgacactggtgaaacaactatgcggtttagatattgtggagaagtacttagaaagtctatctacctatgaacgtgaagctgggttgtaatctaacgtcctgttatctcaagagaaaaggagtggtgtcatcttttttttgttgttgtttgcaataaaacgggaaggaggaaggaggttttctgttatccttaatggtaatggggtttcctcatgtagaaaaaaacaacaggaaggagggaggtgttaaattagcacaatatttgaataatgctttcaaccatctgtattcatgaatccttattaaggctactgggagagggttgtgtttaagtaatttattgtt

SEQ ID NO: 485 - DNA, 727 bp, Sorghum bicolor
tgtgtatgactgtgggaagagcttgaaccctgcgatagacttaggacagattgaaggttcctttatacagggaattggttttttcgtatatgaagagtatattacaaacagtgatggcctgatgattagcaacagcacatgggactacaagatcccaagtgtcgacataatcccaaagcagtttaatgctgaagtgctgaacactggataccataagaaccgtgtgctttcttccaaagctgctggtgaacctgccttggttcttgcctcatccgttcattgtgcactgagagaagctatccgagcagcaagaatggagtttgcaaacagcactgtatctggacgctcaccgctggaattcaagatggatgtcccagcaccaatgacactggtgaaacaactatgcggtttagatattgtggagaagtacttagaaagtctatctacctatgaacgtgaagctgggttgtaatctaacgtcctgttatctcaagagaaaaggagtggtgtcatcttttttttgttgttgtttgtaataaaacgggaaggaggaaggaggttttctgttatccttaatggtaatggggtttcctcatgtagaaaaaaacaacaggaaggagggaggtgttaaattagcacaatatttgaataatgctttcaaccatctgtattcatgaatccttattaaggctactgggagagggttgtgtttaagtaatttattgtt

SEQ ID NO: 486 - protein, 144 aa, Sorghum bicolor
MKPIQDKMVASVPIANFQMTPTTNVTPFSISMQHPNQQSQVHKEAPVVDSATQHLLEENNQLLNQISANIETFKTVENTDLFLRTSNNIKTILSRMSETPGIMGQMPPLPLSINEDHINSLIQLNRLVASYGTASISHHTKQEP

SEQ ID NO: 487 - protein, 448 aa, Sorghum bicolor
MDGQGTKHRILMVSDFFFPNFGGVESHIYYLSQCLLKLGHKVVVMTHAYGNRSGVRYVTNGLKVYYVPWRPFLMQNTLPTLFLTFPIVRTIIIREKISVVHGHQAFSTLCHEALMHARTMGYKVVFTDHSLYGFADAGSIHMNKVLQFTLADIDQAICVSHTSKENTVLRSGISPEKVFMVPNAVDTAMFTPSPKRLSCDEIVIVVISRLVYRKGADLLVEVIPEVCRLFPKVRFIVGGDGPKRVRLEEMREKFSLQDRVEMLGAVPHAQVRSVLISGHIFLNSSLTEAFCIAILEAASCGLLTVSTRVGGVPEVLPDDMIVLAEPAPGDMVRAVKKAIDMLPGIDPQIMHLRMKKLYSWDDVAKRTEIVYDRAMQFPTTNLLDRLPRYLTCGSWAGKLFCLVMIINYLLWRLLEFLQPAEGIEEVPDIGPLHAHLGSKNDFCEAQEK

SEQ ID NO: 488 - protein, 585 aa, Sorghum bicolor
MAMAISSALPCSLLVAALMLLASVVQVQGITRHYDFNVTMANVTRLCASKSIITVNGQFPGPKIVAREGDRLVIRVTNHAQHNISLHWHGIRQLRTGWADGPAYITQCPIQTGQSYVYNYTVVGQRGTLWWHAHISWLRATVYGPLVILPKLGVPYPFPAPYKEVPVIFGEWWLADTEVVIKQALQLGAGPNVSDAHTINGLPGPLYNCSAKDTYKLKVKPGKTYMLRLINAALNDELFFSVANHSLTVVEVDAVYVKPFTVDTLLIAPGQTTNVLLAAKPSYPGANYYMSAAPYSTARPATFDNTTVAGILEYELYPDAPRPSASAGSFNEALPLYRPTLPQLNDTSFVGNFTAKLRSLATPRYPAAVPRTVDRRFFFAVGLGTHPCPANATCQGPTNTTQFAASVNNVSFVLPTKALLHSHFTGLSSGVYSPDFPVAPLAPFNYTGTPPNNTNVASGTKLMVVPYGANVELVMQGTSILGVESHPLHLHGFNFFVVGQGYGNYDPVNDPSKFNLVDPVERNTVGVPAGGWVAIRFLADNPGVWFMHCHLEAHTTWGLRMAWLVLDGSLPHQKLLPPPSDLPKC

SEQ ID NO: 489 - protein, 579 aa, Sorghum bicolor
MAISSALPCSLLMAALMLLASAVEVQGITRHYDFNVTMANVTRLCASKSIITVNGQFPGPKIVAREGDRLVIRVTNHAQHNISLHWHGIRQLRTGWADGPAYITQCPIQTGQSYVYNYTIVGQRGTLWWHAHISWLRATVYGPLVVLPKLGVPYPFPAPYKEVPVIFGEWWLADTEVVIQQALQLGAGPNVSDAHTINGLPGPLYNCSAKDTFKLKVKPGKTYMLRLINAALNDELFFSIANHSLTVVEVDAVYVKPFTVDTLVIAPGQTTNVLLAAKPFYPAANYYMTARTYSTGRPATFDNTTVAGILEYEYPDAPSAAASFNKALPLYRPALPQLNDTSFVGNFTAKLLSLATPEYPAAVPQTVDKRFFFTVGLGTHPCPANTTCQGPTNTTQFAASVNNVSFVLPTKALLHSHFAGLSSGVYESDFPVAPLAPFNYTGTPPNNTNVANGTKLMVIPYGTNVELVMQGTSILGIESHPLHLHGFNFFVVGQGYGNYDPVNDPPKFNLVDPVERNTVGVPAGGWVAIRFLADNPGVWFMHCHLEVHTTWGLRMAWLVLDGSLPHQKLLPPPSDLPKC

SEQ ID NO: 490 - protein, 579 aa, Sorghum bicolor
MATSYLLPCYVLITVLVLFFSVDVTEGAIREYQFDVQMTNVTRLCSSKSIVTVNGQFPGPPVFAREGDFVVIRVVNHVPYNMSIHWHGVRQLRSGWADGPAYITQCPIQSGQSYVYKFTITGQRGTLWWHAHISWLRATVYGAIVILPKPGVPYPFPAPYKEVPVIFGEWWTADTEAVISQALQTGGGPNVSDAFTINGLPGPLYNCSAKDTFKLKVKPGKTYMLRIINAALNDELFFSIAGHPLTVVDVDAVYIKPITVDTILITPGQTTNVLLTTKPSYPGATYYMLAAPYSTARPGTFDNTTVAGILEYEDPTSPPPHAAFNKNLPALKPTLPQINDTSFVANYTAKLRSLATAEYPAAVPQEVDRRFFFTVGLGTHPCAVNGTCQGPTNSSRFAASVNNVSFVLPTTALLQSHFAGKSKGVYSSNFPAAPLVPFNYTGTPPNNTNVANGTKLVVLPYGASVELVLQGTSILGAESHPLHLHGFNFFVVGQGFGNFDPAKDPAKYNLVDPVERNTVGVPAAGWVAIRFRADNPGVWFMHCHLEVHVSWGLKMAWLVLDGDRPNEKLLPPPSDLPRC

SEQ ID NO: 491 - protein, 447 aa, Sorghum bicolor
MAEPAATPTTAAGRKTRVGPYEVGKTIGEGSFAKVKHARDSRTGAVRAIKVLDRNHVLRHKMVEQIKREISTMKLIKHPNVVQLHEVMASRTKIYMVLEFVDGGELFDKIVNSGRLGEDEARIYFHQLINAVDYCHSRGVYHRDLKPENLLLDSHGTLKVSDFGLSAFAPQTKEDGLLHTACGTPNYVAPEVLADKGYDGMAADVWSCGIILFVLMAGYLPFDDANLMRLYKLICQAHVSCPPWFSSGAKKFIKRILDPNPDTRITIAEILKDEWFKKDYKPPRFEQGEDVSLDDVDAAFNDSEDRLVSENREKPESMNAFALISRSQGFNLGNLFEKEMMGMVKRETSFTSQCTAQEIMTKIEDACGPLGFNVRKQNYKMKLKGDKSGRKGHLSVATEVFEVAPSLHMVELRKTGGDTLEFHNFYKNFSTELKDIVWKAESDATKK

SEQ ID NO: 492 - protein, 585 aa, Sorghum bicolor
MASSSALRSSASVVVVVVVAVVLLAAMGAEAETRKYQFDVQMTSVTRLCGTKGIVTVNGQYPGPTLFAREGDHVEVNVVNRSPYNISIHWHGVRQLLSGWADGPSYITQCPIQPGQSYVYRYQIVGQRGTLWWHAHISWLRATVYGPIVILPPAGVPYPFPAPDEEVPVMFGEWWRNDTEAVIAQALQTGGGPNVSDAYTINGLTGPLYNCSAQDTFKLKVKPGKTYMLRLINAALNDELFFSVANHTLTVVDVDALYVKPFTVDTLIIAPGQTSNVLLATKPTYPGAIYYMEARPYTNTQGTFDNTTVAGVLEYEDPSSSSSSGENQSNSNLPVFAPTLPPINDTSFVANYTAKLRSLASAEYPAAVPQDVDRRFFFTVGLGTHPCAGGVNGTCQGPNGSRFAASINNVSFVLPTTALLQAHFAGRSNGVYATNFPAFPPTPFNYAGTPPNNTNVMNGTKVAVLPFGTSVELVLQDTSILGAESHPLHLHGFNFFVVGQGFGNFDPTNDPAKFNLVDPVERNTVGVPAGGWVAIRFRADNPGVWFMHCHLEVHMSWGLKMAWLVLDGSLPNQKLPPPPLDLPQC

SEQ ID NO: 493 - protein, 507 aa, Sorghum bicolor
VKVVNNVKDNVTIHWHGVRQLRTGWSDGPAYVTQCPIQTGQSFVYNFTITGQRGTLFWHAHVSWLRATLYGPIVILPKRGVPYPFLPVKPYKEVPIIFGEWFNADPEAIIAQALQTGAGPNVSDAFTINGLPGPLYNCSSKDTFKLKVLPGKWYLLRLINAALNDELFFSIANHTLTVVDVDASYVKPFHTDIVLITPGQTTNVLLRAEPDAGCAAATHLMLARPYGTGQPGTFDNTTVAAVLEYAPAAAAGHIKSLPLFRPSLPALNDTAFAANYSARLRSLATPEFPATVPRAVDRSFFFAVGLGTNPCPANQTCQGPTNRTKFTASMNNVSFTMPTTALLQAHYDNIAGVYTADFPVAPLEPFNYTGTTPNNTNVSSGTKVVVLEYNTSVEVVLQGTSVLGAESHPLHLHGFDFFVVGQGFGNYDSSKDPAKFNLDDPVQRNTVGVPSGGWVAIRFFADNPGVWFMHCHLEVHTSWGLKMAWVVNDGPLPEQKLMPPPPDLPKC

SEQ ID NO: 494 - protein, 407 aa, Sorghum bicolor
MWQTRGLLLVAVVAAAAALPDGAWAAAAGRCTTSTPIKTYDKCIALPTQGATLAWTYDARNATLDAAFTGSFISPSGWVAWGVNADAPAMTGARVLAAFSDPSTGALLALPFVLSPDVKLQASPLVSRPLDIPLLASSASLVSPARTVRDGARVTVAATIRLSPNRTRVHFVWNRGLYVQGYSPTIHPMDASDLASHATVDILTTATEASPIASTALQWLHGALNAISWGLLLPVGAAVARYLRPCASTGPAWFYAHAAMQATGYTLGAAGFALGLVMGSASPGVTYKLHRGLGIAAATAGSLQTLAMFFRPKTTNRYRKYWKSYHHLVGYGCVVVGVVNVFQGFEVMGLGASYWKLGYCLALATLMGACVALEVNAWVVFCRKQQEEKLMRREVEDVVVKDRAAAF

SEQ ID NO: 495 - protein, 116 aa, Sorghum bicolor
MISNSTWDYKIPSVDIIPKQFNAEVLNTGYHKNRVLSSKAAGEPALVLASSVHCALREAIRAARMEFANSTVSGRSPLEFKMDVPAPMTLVKQLCGLDIVEKYLESLSTYEREAGL

SEQ ID NO: 496 - protein, 116 aa, Sorghum bicolor; identical to SEQ ID NO: 495

SEQ ID NO: 497 - DNA, 21 bp, Artificial sequence
  Arabidopsis miR169a predicted target sequence
acgggaagtcatccttggcta

SEQ ID NO: 498 - DNA, 21 bp, Artificial sequence
  Modified mir target sequence
atggtaaaagcagtctagagc

What is claimed is:

1. A method of increasing tolerance of a corn plant to an abiotic stress selected from the group consisting of drought and nitrogen deficiency, the method comprising:
    (a) expressing within the corn plant a transgenic polynucleotide of a microRNA or a precursor thereof, wherein said microRNA is a corn miR-167,
    (b) growing the corn plant resultant of step (a) under an abiotic stress condition selected from the group consisting of: drought stress and nitrogen deficiency; and
    (c) selecting the corn plant resultant of step (b) for an increased tolerance to an abiotic stress condition selected from the group consisting of: drought stress and nitrogen deficiency,
    thereby increasing the tolerance of the corn plant to the abiotic stress.

2. The method of claim 1, further comprising growing the corn plant resultant of step (c) under said abiotic stress condition.

3. The method of claim 1, wherein said expressing within the corn plant is effected by transforming a cell of said corn plant with said transgenic polynucleotide of a miRNA or a precursor thereof.

4. The method of claim 3, wherein said transforming is effected by introducing into said cell of said corn plant a nucleic acid construct including said transgenic polynucleotide of a miRNA or a precursor thereof and at least one promoter capable of directing transcription of said transgenic polynucleotide of a miRNA or a precursor thereof in said cell of said corn plant.

5. The method of claim 3, wherein said transforming is effected by infecting said corn plant with a bacteria comprising said transgenic polynucleotide of a miRNA or a precursor thereof.

6. A method of evaluating a trait of a corn plant, the method comprising:
    (a) expressing in the corn plant or a portion thereof a nucleic acid construct comprising a transgenic polynucleotide comprising a nucleic acid sequence encoding a corn miR-167 or a precursor thereof, wherein said nucleic acid sequence is under a transcriptional control of at least one promoter capable of directing transcription of the polynucleotide; and
    (b) evaluating a trait of the corn plant of step (a) as compared to a wild type corn plant of the same type wherein said the trait is an increase in tolerance to drought stress or to nitrogen deficiency; thereby evaluating the trait of the corn plant.

\* \* \* \* \*